(12) United States Patent
Lee et al.

(10) Patent No.: US 10,023,876 B2
(45) Date of Patent: Jul. 17, 2018

(54) ENGINEERED PESTICIDAL PROTEINS

(71) Applicant: Syngenta Participations AG, Basel (CH)

(72) Inventors: Mikyong Lee, Research Triangle Park, NC (US); Jeng Shong Chen, Research Triangle Park, NC (US); Cheryl Marie De Fontes, Research Triangle Park, NC (US); Jared Conville, Research Triangle Park, NC (US); Narendra Palekar, Research Triangle Park, NC (US)

(*) Notice: Subject to any disclaimer, the term of this patent is extended or adjusted under 35 U.S.C. 154(b) by 753 days.

(21) Appl. No.: 14/373,933

(22) PCT Filed: Jan. 23, 2013

(86) PCT No.: PCT/US2013/022685
§ 371 (c)(1),
(2) Date: Jul. 23, 2014

(87) PCT Pub. No.: WO2013/122720
PCT Pub. Date: Aug. 22, 2013

(65) Prior Publication Data
US 2015/0020236 A1    Jan. 15, 2015

Related U.S. Application Data

(60) Provisional application No. 61/599,583, filed on Feb. 16, 2012.

(51) Int. Cl.
C12N 15/82      (2006.01)
C07K 14/32      (2006.01)
A01N 63/02      (2006.01)

(52) U.S. Cl.
CPC ......... *C12N 15/8286* (2013.01); *A01N 63/02* (2013.01); *C07K 14/32* (2013.01); *C12N 15/8285* (2013.01); *Y02A 40/162* (2018.01); *Y02A 40/164* (2018.01); *Y02A 50/356* (2018.01)

(58) Field of Classification Search
None
See application file for complete search history.

(56) References Cited

U.S. PATENT DOCUMENTS

| 6,204,435 | B1 | 3/2001 | Feitelson et al. |
| 7,244,820 | B2 | 7/2007 | Miles et al. |
| 7,265,268 | B2 | 9/2007 | Arnaut et al. |
| 7,378,493 | B2 | 5/2008 | Shen et al. |
| 2009/0328254 | A1* | 12/2009 | Shen ............... A01N 63/00 800/279 |
| 2011/0047646 | A1* | 2/2011 | Manzanero ....... C12N 15/8286 800/279 |

FOREIGN PATENT DOCUMENTS

WO    2003075655    9/2003

OTHER PUBLICATIONS

Blandino et al (Effect of sowing date and insecticide application against European corn borer (*Lepidoptera: crambidae*) on fumonisin contamination in maize kernels. Crop protection 27: 1432-1436, 2008).*
Idiong et al (Investigating the effect of a single glycine to alanine substitution on interactions of antimicrobial peptide latarcin 2a with a lipid membrane. Eur Biophys J 40:1087-1100, 2011).*
Wang et al (Improvement of Crystal Solubility and Increasing Toxicity against Caenorhabditis elegans by Asparagine Substitution in Block 3 of Bacillus thuringiensis Crystal Protein Cry5Ba. Applied and Environmental Microbiology 78: 7197-7204, Oct. 2012).*
Tounsi et al (Cloning and study of the expression of a novel cry11a-type gene from *Bacillus thuringiensis* subsp. *kurstaki*. J Appl Microbiol. 95:23-8, Jan. 2003).*
International Search Report dated Oct. 11, 2013 for International Patent Application No. PCT/US2013/022685.

* cited by examiner

*Primary Examiner* — Medina A Ibrahim
*Assistant Examiner* — Wayne Zhong
(74) *Attorney, Agent, or Firm* — Gregory W. Warren

(57) ABSTRACT

Engineered pesticidal polypeptides that are highly active against a wide range of pests and methods of making such polypeptides are disclosed. The nucleotide sequences encoding the pesticidal polypeptide can be used to transform various prokaryotic and eukaryotic organisms, which organisms can be used to produce the pesticidal polypeptides. The recombinant organisms and/or the polypeptides produced by the recombinant organisms can be used to control pests in various environments.

25 Claims, 1 Drawing Sheet

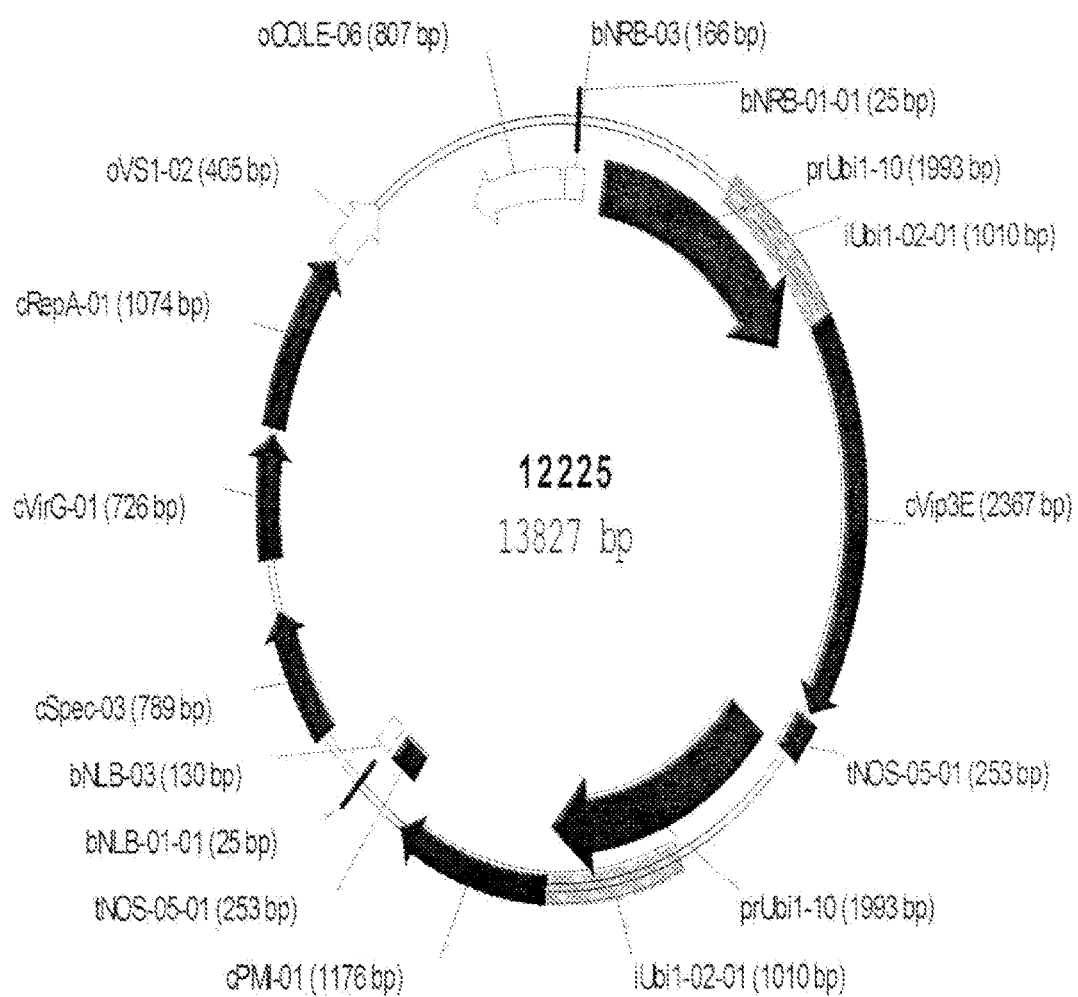

ENGINEERED PESTICIDAL PROTEINS

RELATED APPLICATION INFORMATION

This application claims priority under 35 U.S.C. § 371 from PCT Application No. PCT/US2013/022685, filed Jan. 23, 2013, which claims the benefit of U.S. Provisional Application No. 61/599,583, filed Feb. 16, 2012, the disclosures of which are incorporated by reference herein in their entirety.

STATEMENT REGARDING ELECTRONIC SUBMISSION OF A SEQUENCE LISTING

A Sequence Listing in ASCII text format, submitted under 37 C.F.R. § 1.821, entitled 72597_WO_REG_ORG_P_1_01Apr2013_SequenceListingRevisionsRule 13ter 721 KB in size, generated on Apr. 1, 2013 and filed via EFS-Web is provided in lieu of a paper copy. This Sequence Listing is hereby incorporated by reference into the specification for its disclosures.

FIELD OF THE INVENTION

The invention relates to engineered polypeptides with altered pesticidal activity to target organisms, polynucleotides encoding the polypeptides, and methods of making and using the polypeptides and corresponding polynucleotides to control pests.

BACKGROUND

Plant pests are a major factor in the loss of the world's important agricultural crops. About $8 billion are lost every year in the U.S. alone due to infestations of non-mammalian pests including insects. In addition to losses in field crops, insect pests are also a burden to vegetable and fruit growers, to producers of ornamental flowers, and to home gardeners.

Insect pests are mainly controlled by intensive applications of chemical pesticides, which are active through inhibition of insect growth, prevention of insect feeding or reproduction, or cause death. Good insect control can thus be reached, but these chemicals can sometimes also affect beneficial insects and may not be able to reach the site of infestation. Another problem resulting from the wide use of chemical pesticides is the appearance of resistant insect varieties. This has been partially alleviated by various resistance management practices, but there is an increasing need for alternative pest control agents.

Biological pest control agents, such as *Bacillus thuringiensis* strains expressing pesticidal polypeptides like delta (δ)-endotoxins (also called Cry proteins), have also been applied to crop plants with satisfactory results, thus offering an alternative or compliment to chemical pesticides. The genes coding for some of these Cry proteins have been isolated and their expression in heterologous hosts have been shown to provide another tool for the control of economically important insect pests. In particular, the expression of Cry proteins in transgenic plants has provided efficient protection against certain insect pests, and transgenic plants expressing such proteins have been commercialized, allowing farmers to reduce or eliminate applications of chemical insect control agents.

Other, non-endotoxin genes and the proteins they encode have also been identified. U.S. Pat. Nos. 5,877,012, 6,107,279, 6,137,033, and 6,291,156, as well as Estruch et al. (1996, *Proc. Natl. Acad. Sci.* 93:5389-5394) and Yu et al. (1997, *Appl. Environ. Microbiol.* 63:532-536), all herein incorporated by reference, describe a new class of insecticidal proteins called Vip3. Vip3 coding sequences encode approximately 88 kDa proteins that are produced and secreted by *B. thuringiensis* during its vegetative stage of growth (vegetative insecticidal proteins or Vip). The Vip3A protein possesses insecticidal activity against a wide spectrum of lepidopteran pests, including, but not limited to, black cutworm (BCW, *Agrotis ipsilon*), fall armyworm (FAW, *Spodoptera frugiperda*), tobacco budworm (TBW, *Heliothis virescens*), and corn earworm (CEW, *Helicoverpa zea*), but has no activity against the European corn borer (ECB, *Ostrinia nubilalis*). More recently, plants expressing the Vip3A protein have been found to be resistant to feeding damage caused by hemipteran insect pests (U.S. Pat. No. 6,429,360). Thus, the Vip3A protein displays a unique spectrum of insecticidal activities. WO03/075655, WO02/078437, WO 98/18932, WO 98/33991, WO 98/00546, and WO 99/57282, have identified other members of the Vip3 class of proteins.

One concern raised regarding the deployment of transgenic crops expressing insecticidal proteins is whether insect pests will become resistant to the insecticidal proteins. The seed industry, university researchers and the US Environmental Protection Agency have worked together to develop management plans to help mitigate the onset of insect resistance. These plans are based primarily on a high dose and refuge strategy. A high dose strategy for European corn borer in corn, for example, is to use corn hybrids that express high enough levels of an insecticidal protein to kill even partially resistant European corn borers. The underlying hypothesis is that killing partially resistant ECB and preventing their mating greatly delays the development of resistance. The success of a high dose strategy depends in part on the specific activity of the insecticidal protein to European corn borer and how much of that protein can be expressed in the transgenic corn plant. For example, the higher the specific activity of an insecticidal protein to a pest, less of the insecticidal protein is required to be expressed in a transgenic plant to achieve a high dose strategy. Thus, for example, because the Cry protein, Cry1Ab, is very toxic to European corn borer larvae (i.e. high specific activity), the levels of expression of Cry1Ab that are achievable in transgenic plants easily places such corn hybrids in a high dose category.

Therefore, there remains a need to discover new and effective pest control agents that provide an economic benefit to farmers and that are environmentally acceptable. Particularly needed are control agents that are targeted to a wider spectrum of economically important insect pests and that have a high specific activity against insect pests that are or could become resistant to existing insect control agents. Furthermore, agents whose application minimizes the burden on the environment are desirable.

Accordingly, the invention addresses the previous shortcomings in the art by providing compositions comprising Vip polypeptides having altered pesticidal (e.g., insecticidal) activity against a target organism (e.g., an insect) and/or altered levels/degrees of toxicity toward any particular cell and/or organism as well as methods for making and using such polypeptides.

SUMMARY

In one aspect, the invention provides an engineered pesticidal polypeptide comprising an amino acid sequence having at least 95% identity to SEQ ID NO: 1 (Vip3D) and further comprising at least one amino acid mutation at a position that corresponds to a position identified in Table 1, or any combination thereof, wherein the mutation improves pesticidal activity against at least *Ostrinia nubilalis* (European corn borer, ECB) compared to the ECB activity of a wild-type polypeptide from which the engineered pesticidal polypeptide is derived. In some aspects of the invention a composition comprising an engineered polypeptide of the invention is provided. In other aspects, a nucleic acid molecule comprising a nucleotide sequence encoding an engineered pesticidal polypeptide of the invention is provided.

In another aspect, the invention also provides a transgenic non-human host cell comprising a nucleic acid molecule of the invention.

Another aspect of the invention provides a method of producing a polypeptide having pesticidal activity against at least European corn borer, the method comprising expressing a nucleic acid molecule of the invention in a transgenic non-human host cell, thereby producing a polypeptide that has pesticidal activity against at least European corn borer.

Additionally provided is a method of producing a pest-resistant transgenic plant, the method comprising introducing into a plant a recombinant nucleic acid molecule comprising a nucleotide sequence of the invention, wherein the nucleotide sequence encodes a pesticidal polypeptide of the invention that is expressed in the plant, thereby conferring on the plant resistance to at least European corn borer, and producing a pest-resistant transgenic plant. In some embodiments, the pest is an insect pest.

In additional embodiments of the invention a method of controlling insects is provided, the method comprising delivering to the insects an effective amount of the engineered pesticidal polypeptide of the invention. In some aspects of the invention the insects are lepidopteran insects. In other aspects of the invention, the lepidopteran insects are European corn borer and fall armyworm. In some aspects of the invention, the engineered polypeptide of the invention is delivered to the insects orally.

A further aspect of the invention provides a method of producing a pesticidal polypeptide having improved pesticidal activity against a target cell and/or organism, the method comprising: a) aligning a plurality of amino acid sequences of polypeptides, wherein at least one of the polypeptides exhibits at least moderate pesticidal activity toward the target cell and/or organism; b) identifying at least one amino acid residue that differs between at least two of the aligned amino acid sequences of (a); c) substituting an amino acid residue for at least one amino acid residue identified in step (b) to produce a modified polypeptide; d) determining the level of pesticidal activity of the modified polypeptide produced at step (c) against the target cell and/or organism; and e) selecting a modified polypeptide of (d) having improved pesticidal activity against the target cell and/or organism, thereby producing a polypeptide having improved pesticidal activity against the target cell and/or organism. In some aspects of the invention, the pesticidal activity is insecticidal activity and the target cell or organism is an insect cell or insect. In other aspects of the invention, the identifying at least one amino acid residue that differs between at least two of the aligned amino acid sequences comprises identifying an essential amino acid position, a synergist amino acid position, a cryptic synergist amino acid position, or any combination thereof, in the aligned amino acid sequences.

Other and further objects, features and advantages would be apparent and more readily understood by reading the following specification and by reference to the accompanying drawing forming a part thereof, or any examples of the embodiments of the invention given for the purpose of the disclosure.

BRIEF DESCRIPTION OF THE FIGURE

FIG. 1 shows the 12225 vector useful for transforming plants with a polynucleotide of the invention.

BRIEF DESCRIPTION OF SEQUENCES IN THE SEQUENCE LISTING

SEQ ID NO:1 is the amino acid sequence of Vip3D.
SEQ ID NO:2 is a nucleotide sequence which encodes SEQ ID NO:1 (Vip3D).
SEQ ID NO:3 is the amino acid sequence of the K455A mutant of Vip3D polypeptide (Vip3E).
SEQ ID NO:4 is a nucleotide sequence which encodes SEQ ID NO:3.
SEQ ID NO:5 is the amino acid sequence of the V338A mutant of Vip3D polypeptide.
SEQ ID NO:6 is a nucleotide sequence which encodes SEQ ID NO:5.
SEQ ID NO:7 is the amino acid sequence of the V768A mutant Vip3D polypeptide.
SEQ ID NO:8 is a nucleotide sequence which encodes SEQ ID NO:7.
SEQ ID NO:9 is the amino acid sequence of the I544A mutant Vip3D polypeptide.
SEQ ID NO:10 is a nucleotide sequence which encodes SEQ ID NO: 9.
SEQ ID NO:11 is the amino acid sequence of the E760A mutant Vip3D polypeptide.
SEQ ID NO:12 is a nucleotide sequence which encodes SEQ ID NO:11.
SEQ ID NO:13 is the amino acid sequence of the S712A mutant Vip3D polypeptide.
SEQ ID NO:14 is a nucleotide sequence which encodes SEQ ID NO: 13.
SEQ ID NO:15 is the amino acid sequence of Vip3A.
SEQ ID NO:16 is the amino acid sequence of Vip3B.
SEQ ID NO:17 is the amino acid sequence of Vip3C.
SEQ ID NO:18 is the amino acid sequence of the R465A mutant Vip3D polypeptide.
SEQ ID NO:19 is a nucleotide sequence which encodes SEQ ID NO:18.
SEQ ID NO:20 is the amino acid sequence of the S532A mutant Vip3D polypeptide.
SEQ ID NO:21 is a nucleotide sequence which encodes SEQ ID NO:20.
SEQ ID NO:22 is the amino acid sequence of the G580A mutant Vip3D polypeptide.
SEQ ID NO:23 is a nucleotide sequence which encodes SEQ ID NO:22.
SEQ ID NO:24 is the amino acid sequence of the L766A mutant Vip3D polypeptide.
SEQ ID NO:25 is a nucleotide sequence which encodes SEQ ID NO:24.
SEQ ID NO:26 is the amino acid sequence of the D471A mutant Vip3D polypeptide.
SEQ ID NO:27 is a nucleotide sequence which encodes SEQ ID NO:26.
SEQ ID NO:28 is the amino acid sequence of the Q495A mutant Vip3D polypeptide.
SEQ ID NO:29 is a nucleotide sequence which encodes SEQ ID NO:28.

SEQ ID NO:30 is the amino acid sequence of the R501A mutant Vip3D polypeptide.
SEQ ID NO:31 is a nucleotide sequence which encodes SEQ ID NO:30.
SEQ ID NO:32 is the amino acid sequence of the S543A mutant Vip3D polypeptide.
SEQ ID NO:33 is a nucleotide sequence which encodes SEQ ID NO:32.
SEQ ID NO:34 is the amino acid sequence of the P591A mutant Vip3D polypeptide.
SEQ ID NO:35 is a nucleotide sequence which encodes SEQ ID NO:34.
SEQ ID NO:36 is the amino acid sequence of the P605A mutant Vip3D polypeptide.
SEQ ID NO:37 is a nucleotide sequence which encodes SEQ ID NO:36.
SEQ ID NO:38 is the amino acid sequence of the H608A mutant Vip3D polypeptide.
SEQ ID NO:39 is a nucleotide sequence which encodes SEQ ID NO:38.
SEQ ID NO:40 is the amino acid sequence of the Y616A mutant Vip3D polypeptide.
SEQ ID NO:41 is a nucleotide sequence which encodes SEQ ID NO:40.
SEQ ID NO:42 is the amino acid sequence of the 1617A mutant Vip3D polypeptide.
SEQ ID NO:43 is a nucleotide sequence which encodes SEQ ID NO:42.
SEQ ID NO:44 is the amino acid sequence of the H618A mutant Vip3D polypeptide.
SEQ ID NO:45 is a nucleotide sequence which encodes SEQ ID NO:44.
SEQ ID NO:46 is the amino acid sequence of the R635A mutant Vip3D polypeptide.
SEQ ID NO:47 is a nucleotide sequence which encodes SEQ ID NO:46.
SEQ ID NO:48 is the amino acid sequence of the K643A mutant Vip3D polypeptide.
SEQ ID NO:49 is a nucleotide sequence which encodes SEQ ID NO:48.
SEQ ID NO:50 is the amino acid sequence of the W658A mutant Vip3D polypeptide.
SEQ ID NO:51 is a nucleotide sequence which encodes SEQ ID NO:50.
SEQ ID NO:52 is the amino acid sequence of the P681A mutant Vip3D polypeptide.
SEQ ID NO:53 is a nucleotide sequence which encodes SEQ ID NO:52.
SEQ ID NO:54 is the amino acid sequence of the 1753A mutant Vip3D polypeptide.
SEQ ID NO:55 is a nucleotide sequence which encodes SEQ ID NO:54.
SEQ ID NO:56 is the amino acid sequence of the S774A mutant Vip3D polypeptide.
SEQ ID NO:57 is a nucleotide sequence which encodes SEQ ID NO:56.
SEQ ID NO:58 is the amino acid sequence of the G775A mutant Vip3D polypeptide.
SEQ ID NO:59 is a nucleotide sequence which encodes SEQ ID NO:58.
SEQ ID NO:60 is the amino acid sequence of the H779A mutant Vip3D polypeptide.
SEQ ID NO:61 is a nucleotide sequence which encodes SEQ ID NO:60.
SEQ ID NO:62 is the amino acid sequence of the L514A mutant Vip3D polypeptide.
SEQ ID NO:63 is a nucleotide sequence which encodes SEQ ID NO:62.
SEQ ID NO:64 is the amino acid sequence of the E546A mutant Vip3D polypeptide.
SEQ ID NO:65 is a nucleotide sequence which encodes SEQ ID NO:64.
SEQ ID NO:66 is the amino acid sequence of the T614A mutant Vip3D polypeptide.
SEQ ID NO:67 is a nucleotide sequence which encodes SEQ ID NO:66.
SEQ ID NO:68 is the amino acid sequence of the T724A mutant Vip3D polypeptide.
SEQ ID NO:69 is a nucleotide sequence which encodes SEQ ID NO:68.
SEQ ID NO:70 is the amino acid sequence of the T743A mutant Vip3D polypeptide.
SEQ ID NO:71 is a nucleotide sequence which encodes SEQ ID NO:70.
SEQ ID NO:72 is the amino acid sequence of the 5744A mutant Vip3D polypeptide.
SEQ ID NO:73 is a nucleotide sequence which encodes SEQ ID NO:72.
SEQ ID NO:74 is the amino acid sequence of the T756A mutant Vip3D polypeptide.
SEQ ID NO:75 is a nucleotide sequence which encodes SEQ ID NO:74.
SEQ ID NO:76 is the amino acid sequence of the S761A mutant Vip3D polypeptide.
SEQ ID NO:77 is a nucleotide sequence which encodes SEQ ID NO:76.
SEQ ID NO:78 is the amino acid sequence of the T764A mutant Vip3D polypeptide.
SEQ ID NO:79 is a nucleotide sequence which encodes SEQ ID NO:78.
SEQ ID NO:80 is the amino acid sequence of the G778A mutant Vip3D polypeptide.
SEQ ID NO:81 is a nucleotide sequence which encodes SEQ ID NO:80.
SEQ ID NO:82 is the amino acid sequence of the V785A mutant Vip3D polypeptide.
SEQ ID NO:83 is a nucleotide sequence which encodes SEQ ID NO:82.
SEQ ID NO:84 is the amino acid sequence of the M362A mutant Vip3D polypeptide.
SEQ ID NO:85 is a nucleotide sequence which encodes SEQ ID NO:84.
SEQ ID NO:86 is the amino acid sequence of the L494A mutant Vip3D polypeptide.
SEQ ID NO:87 is a nucleotide sequence which encodes SEQ ID NO:86.
SEQ ID NO:88 is the amino acid sequence of the 1503A mutant Vip3D polypeptide.
SEQ ID NO:89 is a nucleotide sequence which encodes SEQ ID NO:88.
SEQ ID NO:90 is the amino acid sequence of the T600A mutant Vip3D polypeptide.
SEQ ID NO:91 is a nucleotide sequence which encodes SEQ ID NO:90.
SEQ ID NO:92 is the amino acid sequence of the N625A mutant Vip3D polypeptide.
SEQ ID NO:93 is a nucleotide sequence which encodes SEQ ID NO:92.
SEQ ID NO:94 is the amino acid sequence of the Y629A mutant Vip3D polypeptide.
SEQ ID NO:95 is a nucleotide sequence which encodes SEQ ID NO:94.

SEQ ID NO:96 is the amino acid sequence of the K650A mutant Vip3D polypeptide.

SEQ ID NO:97 is a nucleotide sequence which encodes SEQ ID NO:96.

SEQ ID NO:98 is the amino acid sequence of the N682A mutant Vip3D polypeptide.

SEQ ID NO:99 is a nucleotide sequence which encodes SEQ ID NO:98.

SEQ ID NO:100 is the amino acid sequence of the S683A mutant Vip3D polypeptide.

SEQ ID NO:101 is a nucleotide sequence which encodes SEQ ID NO:100.

SEQ ID NO:102 is the amino acid sequence of the L701A mutant Vip3D polypeptide.

SEQ ID NO:103 is a nucleotide sequence which encodes SEQ ID NO:102.

SEQ ID NO:104 is the amino acid sequence of the M747A mutant Vip3D polypeptide.

SEQ ID NO:105 is a nucleotide sequence which encodes SEQ ID NO:104.

SEQ ID NO:106 is the amino acid sequence of the R773A mutant Vip3D polypeptide.

SEQ ID NO:107 is a nucleotide sequence which encodes SEQ ID NO:106.

SEQ ID NO:108 is the amino acid sequence of the V372A mutant Vip3D polypeptide.

SEQ ID NO:109 is a nucleotide sequence which encodes SEQ ID NO:108.

SEQ ID NO:110 is the amino acid sequence of the G689 mutant Vip3D polypeptide.

SEQ ID NO:111 is a nucleotide sequence which encodes SEQ ID NO:110.

SEQ ID NO:112 is the amino acid sequence of the F400A mutant Vip3D polypeptide.

SEQ ID NO:113 is a nucleotide sequence which encodes SEQ ID NO:112.

SEQ ID NO:114 is a Vip3-specific amino acid sequence comprised in the highly conserved N-terminal secretion signal.

SEQ ID NO:115 is the amino acid sequence of the I544A/5712A mutant Vip3D polypeptide.

SEQ ID NO:116 is a nucleotide sequence which encodes SEQ ID NO:115.

SEQ ID NO:117 is the amino acid sequence of the K455A/V338A mutant Vip3D polypeptide.

SEQ ID NO:118 is a nucleotide sequence which encodes SEQ ID NO:117.

SEQ ID NO:119 is the amino acid sequence of the H618A/T750A mutant Vip3D polypeptide.

SEQ ID NO:120 is a nucleotide sequence which encodes SEQ ID NO:119.

SEQ ID NO:121 is the amino acid sequence of the L701A/I721A mutant Vip3D polypeptide.

SEQ ID NO:122 is a nucleotide sequence which encodes SEQ ID NO:121.

SEQ ID NO:123 is the amino acid sequence of the S722A/S781A mutant Vip3D polypeptide.

SEQ ID NO:124 is a nucleotide sequence which encodes SEQ ID NO:123.

SEQ ID NO:125 is the amino acid sequence of the S761A/S744A mutant Vip3D polypeptide.

SEQ ID NO:126 is a nucleotide sequence which encodes SEQ ID NO:125.

SEQ ID NO:127 is the amino acid sequence of the S781A/S744A mutant Vip3D polypeptide.

SEQ ID NO:128 is a nucleotide sequence which encodes SEQ ID NO:127.

SEQ ID NO:129 is the amino acid sequence of the S781A/T750A mutant Vip3D polypeptide.

SEQ ID NO:130 is a nucleotide sequence which encodes SEQ ID NO:129.

SEQ ID NOs:131-252 are $X_1$cgc$X_2$ primers useful for making alanine substitutions.

SEQ ID NOs:253-340 are primers useful for changing a first and/or second position of mutated vip3 codons for making alanine substitutions.

SEQ ID NOs:341-452 are primers useful for making spin mutants.

SEQ ID NO:453 is an amino acid epitope encoded in site-directed mutagenesis vectors useful in the invention.

SEQ ID NO: 454 is a maize-optimized nucleotide sequence encoding Vip3E (K455A mutant).

SEQ ID NO: 455 is an amino acid sequence of a Cry2Aa polypeptide.

SEQ ID NO: 456 is an amino acid sequence of a Cry2Ab polypeptide.

SEQ ID NO: 457 is an amino acid sequence of a Cry2Ac polypeptide.

DETAILED DESCRIPTION

This invention relates to modifying Vip polypeptides, methods of modifying Vip polypeptides to increase pesticidal activity, for example pesticidal activity against selected pests (e.g., insect pests), and to the making and using of the polypeptides to control such pests. In particular, modified Vip3 polypeptides, useful as pesticidal agents, are provided.

This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications and patent applications mentioned in this specification are indicative of the level of skill of those skilled in the art that this invention pertains. Further, publications, patent applications, patents, and other references mentioned herein are incorporated by reference in their entirety.

As used in the description of the embodiments of the invention and the appended claims, the singular forms "a," "an," and "the" are intended to include the plural forms as well, unless the context clearly indicates otherwise.

As used herein, "and/or" refers to and encompasses any and all possible combinations of one or more of the associated listed items.

The term "about," as used herein when referring to a measurable value such as an amount of a compound, dose, time, temperature, and the like, is meant to encompass variations of 20%, 10%, 5%, 1%, 0.5%, or even 0.1% of the specified amount.

The terms "comprises" and/or "comprising," when used in this specification, specify the presence of stated features, integers, steps, operations, elements, and/or components, but do not preclude the presence or addition of one or more other features, integers, steps, operations, elements, components, and/or groups thereof.

As used herein, the transitional phrase "consisting essentially of (and grammatical variants) means that the scope of a claim is to be interpreted to encompass the specified materials or steps recited in the claim" and those that do not materially alter the basic and novel characteristic(s)" of the claimed invention. Thus, the term "consisting essentially of" when used in a claim of this invention is not intended to be interpreted to be equivalent to "comprising."

"Activity" of the Vip3 polypeptides of the invention is meant that the Vip3 polypeptides function as a bioactive control agent. Thus, for example, when acting as an insecticide, a Vip3 polypeptide of the invention acts as an orally active insect control agent, has a toxic effect, and/or is able to disrupt or deter insect feeding, which may or may not cause death of the insect. When a Vip3 polypeptide of the invention is delivered to the insect, the result is typically death of the insect, or the insect ceases feeding upon the source that makes the Vip3 polypeptide available to the insect.

The terms "modify," "modifying" and/or "modification" (and grammatical variants thereof) as used herein with regard to the Vip polypeptides and the polynucleotides encoding the Vip polypeptides refers to changing the wild-type or reference Vip amino acid and polynucleotides such that the toxicity of the polypeptides produced from the altered amino acid and polynucleotides is changed relative to the toxicity of the wild type or reference Vip amino acid and polynucleotide. Specific modifications to amino acid sequences are labeled by designating the single letter for the amino acid to be modified, the position of the modification and the single letter code for the replacement amino acid. For example, "V338A" means that the valine at position 338 was replaced with an alanine. A "change in toxicity" of a Vip polypeptide includes, but is not limited to, an increase and/or decrease in toxicity as it pertains to any particular target organism and/or a change in the organism(s) that are targeted.

As used herein, "operatively linked," when referring to a first nucleic acid sequence that is operatively linked to a second nucleic acid sequence, means a situation when the first nucleic acid sequence is placed in a functional relationship with the second nucleic acid sequence. For example, a promoter is operatively linked to a coding sequence if the promoter affects the transcription or expression of the coding sequence. Operatively linked nucleic acid sequences may be contiguous or they may be, for example for transcriptional enhancers, distal to one another.

A "chimeric gene" is a recombinant nucleic acid molecule in which a promoter or regulatory polynucleotide is operatively linked to a polynucleotide that codes for an mRNA or which is expressed as a polypeptide, such that the regulatory polynucleotide is able to regulate transcription or expression of the associated polynucleotide that codes for an mRNA or which is expressed as a polypeptide. The regulatory polynucleotide of the chimeric gene is not normally operatively linked to the associated polynucleotide that codes for an mRNA or which is expressed as a polypeptide as found in nature.

A "coding sequence" is a polynucleotide that is transcribed into ribonucleic acid (RNA) such as pre-RNA, mRNA, rRNA, tRNA, snRNA, sense RNA or antisense RNA. In some embodiments, the RNA is then translated in an organism or a cell to produce a protein.

To "control" an organism (e.g., insect pest) means to inhibit, through a toxic effect, the ability of an organism (e.g., insect pest) to survive, grow, feed, and/or reproduce, or to limit damage or loss in crop plants that is related to the activity of the organism. To "control" an organism may or may not mean killing the organism, although it preferably means killing the organism.

"Corresponding to" or "corresponds to" in the context of the invention means that when amino acid sequences of variant Vip3 polypeptides, either wild-type or engineered, are aligned with a reference Vip3 amino acid sequence, the amino acids of the variant Vip3 polypeptides that line up with certain enumerated amino acid positions of the reference Vip3 amino acid sequence, but that are not necessarily in these exact numerical positions relative to the particular variant Vip3 amino acid sequence, the amino acid in the variant "corresponds to" that position in the reference amino acid sequence. For example, without limitation, when a Vip3A amino acid sequence (SEQ ID NO: 15) is aligned with a reference Vip3D amino acid sequence (SEQ ID NO: 1), the serine (S) at amino acid position 753 and the glutamic acid (E) at position 754 of SEQ ID NO: 15 aligns with the serine (S) at amino acid position 754 and the Glycine (G) at amino acid position 755 of SEQ ID NO: 1. Therefore, according to the invention, S753 and E754 of Vip3A (SEQ ID NO: 15) "corresponds to" S754 and G755, respectively, of Vip3D (SEQ ID NO: 1). In a further non-limiting example, when a Cry2Ac amino acid sequence (SEQ ID NO:457) is aligned with a reference Cry2Aa amino acid sequence (SEQ ID NO:455), the arginine at amino acid position 517 of SEQ ID NO:457 aligns with the glutamine at amino acid position 527 of SEQ ID NO:455. Therefore, according to the invention, R517 of Cry2Ac (SEQ ID NO:457) corresponds to Q527 of Cry2Aa (SEQ ID NO:455).

As used herein "pesticidal," insecticidal," "nematicidal," and the like, refer to the ability of a Vip polypeptide (e.g., a Vip3 polypeptide) to control a pest organism or an amount of a Vip polypeptide (e.g., a Vip3 polypeptide) that can control a pest organism as defined herein. Thus, a pesticidal Vip polypeptide (e.g., a Vip3 polypeptide) can kill or inhibit the ability of a pest organism (e.g., insect pest) to survive, grow, feed, and/or reproduce.

For purposes of some embodiments of the invention, insect pests include without limitation insects selected from the orders *Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera*, and the like. In some aspects of the invention, the insect pests are from the order Lepidoptera. Such lepidopteran insects include without limitation, *Ostrinia nubilalis* (European corn borer), *Plutella xylostella* (diamondback moth), *Spodoptera frugiperda* (fall armyworm), *Agrotis ipsilon* (black cutworm), *Helicoverpa zea* (corn earworm), *Heliothis virescens* (tobacco budworm), *Spodoptera exigua* (beet armyworm), *Diatraea grandiosella* (southwestern corn borer), *Diatraea saccharalis* (sugarcane borer), *Trichoplusia ni* (cabbage looper), *Sesamia nonagroides* (mediterranean corn borer), *Pectinophora gos-*

*sypiella* (pink bollworm), *Cochylis hospes* (banded sunflower moth), *Helicoverpa punctigera* (native budworm), *Helicoverpa armigera* (cotton bollworm), and/or any combination thereof.

In other aspects of the invention, nonlimiting examples of nematode pests include *Criconemella, Ditylenchus, Globodera, Helicotylenchus, Heterodera, Longidorus, Meloidogyne, Paratrichodorus, Pratylenchus, Radolpholus, Rotelynchus, Rotylenchulus, Tylenchulus, Xiphinema* and/or any combination thereof. In particular embodiments, nematode pests include without limitation, *Meloidogyne* spp. (for example, *Meloidogyne incoginita* and *Meloidogyne javanica, Meloidogyne hapla, Meloidogyne arenari*), *Heterodera* spp. (for example, *Heterodera glycines, Heterodera carotae, Heterodera schachtii, Heterodora avenae* and *Heterodora trifolii*), *Globodera* spp. (for example, *Globodera rostochiensis*), *Radopholus* spp. (for example, *Radopholus similes*), *Rotylenchulus* spp., *Pratylenchus* spp. (for example, *Pratylenchus neglectans* and *Pratylenchus penetrans*), *Aphelenchoides* spp., *Helicotylenchus* spp., *Hoplolaimus* spp., *Paratrichodorus* spp., *Longidorus* spp., *Nacobbus* spp., *Subanguina* spp. *Belonlaimus* spp., *Criconemella* spp., *Criconemoides* spp. *Ditylenchus* spp., *Ditylenchus dipsaci, Dolichodorus* spp., *Hemicriconemoides* spp., *Hemicycliophora* spp., *Hirschmaniella* spp., *Hypsoperine* spp., *Macroposthonia* spp., *Melinius* spp., *Punctodera* spp., *Quinisulcius* spp., *Scutellonema* spp., *Xiphinema* spp., *Tylenchorhynchus* spp. and/or any combination thereof.

"Effective pest controlling amount," "effective insect-controlling amount" or "effective nematode controlling amount" means that concentration or amount of a polypeptide that inhibits, through a toxic effect, the ability of pests, insects and/or nematodes, respectively, to survive, grow, feed and/or reproduce, or to limit pest-, insect- and/or nematode-related damage or loss in crop plants. "Effective pest controlling amount," "effective insect-controlling amount" or "effective nematode controlling amount" may or may not mean killing the pests, insects, and/or nematodes, respectively, although it preferably means killing the pests, insects, and/or nematodes.

As used herein, the term "gene" refers to a nucleic acid molecule capable of being used to produce mRNA or antisense RNA. Genes may or may not be capable of being used to produce a functional protein. Genes can include both coding and non-coding regions (e.g., introns, regulatory elements, promoters, enhancers, termination sequences and 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

"Polynucleotide of interest" refers to any polynucleotide which, when transferred to a plant, confers upon the plant a desired characteristic such as antibiotic resistance, virus resistance, insect resistance, disease resistance, or resistance to other pests, herbicide tolerance, improved nutritional value, improved performance in an industrial process or altered reproductive capability. The "polynucleotide of interest" may also be one that is transferred to plants for the production of commercially valuable enzymes or metabolites in the plant.

A "heterologous polynucleotide" is a polynucleotide not naturally associated with a host cell into which it is introduced, including non-naturally occurring multiple copies of a naturally occurring polynucleotide.

"Wild type" nucleic acid, nucleotide sequence, polynucleotide, polypeptide or amino acid sequence refers to a naturally occurring ("native") or endogenous nucleic acid, nucleotide sequence, polynucleotide, polypeptide or amino acid sequence. Thus, for example, a "wild type mRNA" is an mRNA that is naturally occurring in or endogenous to the organism. A "homologous polynucleotide" is a polynucleotide naturally associated with a host cell into which it is introduced.

"Homologous recombination" is the reciprocal exchange of nucleic acid fragments between homologous nucleic acid molecules.

"Hybrid toxin" as used herein is a pesticidal (e.g., insecticidal) toxin made by the hand of man which comprises amino acid regions or fragments of one toxin joined with amino acid regions or fragments from a different toxin.

A nucleic acid sequence is "isocoding with" a reference nucleic acid sequence when the nucleic acid sequence encodes a polypeptide having the same amino acid sequence as the polypeptide encoded by the reference nucleic acid sequence.

"Improved Vip3 polypeptide" is a mutant Vip3 polypeptide that, when compared to its wild-type parent Vip3 polypeptide, displays one or more of the following characteristics: 1) an increased potency against a target insect (higher specific activity) or an increased kill rate (faster kill at comparable level of protein); 2) increased or decreased target pest spectrum; 3) decreased susceptibility to development of resistance by target pests; 4) increased expression levels in a transgenic host or host cell; 5) increased resistance to insect protease degradation (increased stability in the target insect gut); 6) increased stability in the environment; and 7) reduced toxicity to beneficial insects, non-target pests, and plants.

In the context of the invention, "improves pesticidal (e.g., insecticidal, nematicidal) activity" or "improved pesticidal (e.g., insecticidal, nematicidal) activity," or any grammatical variation thereof, means that a mutation of the invention results in an engineered polypeptide of the invention having one or more of the following characteristics: 1) an increased potency against a target pest (e.g., insect and/or nematode) (i.e., higher specific activity) or an increased kill rate (faster kill at comparable level of protein), 2) increased or decreased target pest spectrum, 3) decreased susceptibility to development of resistance by target pests, 4) increased expression levels in a transgenic host or host cell, 5) increased resistance to insect protease degradation (increased stability in the target insect gut), 6) increased stability in the environment and 7) reduced toxicity to beneficial insects, non-target pests, and plants.

An "isolated" nucleic acid molecule or an "isolated" polypeptide is a nucleic acid molecule or polypeptide that, by the hand of man, exists apart from its native environment and is therefore not a product of nature. An isolated nucleic acid molecule or isolated polypeptide may exist in a purified form or may exist in a non-native environment such as, for example, a recombinant host cell. Thus, for example, with respect to polynucleotides, the term isolated means that it is separated from the chromosome and/or cell in which it naturally occurs. A polynucleotide is also isolated if it is separated from the chromosome and/or cell in which it naturally occurs in and is then inserted into a genetic context, a chromosome and/or a cell in which it does not naturally occur. The engineered polypeptides, the nucleotide sequences encoding the engineered polypeptides, and recombinant nucleic acid molecules of this invention can be considered to be "isolated" as defined above, including when comprised in a transgenic plant or transgenic plant cell.

A "nucleic acid molecule," "nucleic acid sequence," "polynucleotide" or "nucleotide sequence" is a linear segment of single- or double-stranded DNA or RNA that can be isolated from any source.

"Regulatory elements" refer to sequences involved in controlling the expression of a polynucleotide. Thus, for example, regulatory elements can comprise a promoter operatively linked to the polynucleotide of interest and termination signals. Regulatory elements also typically encompass sequences required for proper translation of the polynucleotide.

A "shuffled" nucleic acid is a nucleic acid produced by a shuffling procedure such as any shuffling procedure set forth herein. Shuffled nucleic acids are produced by recombining (physically or virtually) two or more nucleic acids (or character strings), e.g., in an artificial, and optionally recursive, fashion. Generally, one or more screening steps are used in shuffling processes to identify polynucleotides of interest; this screening step can be performed before or after any recombination step. In some (but not all) shuffling embodiments, it is desirable to perform multiple rounds of recombination prior to selection to increase the diversity of the pool to be screened. The overall process of recombination and selection are optionally repeated recursively. Depending on context, shuffling can refer to an overall process of recombination and selection, or, alternately, can simply refer to the recombinational portions of the overall process.

As used herein, "specific activity" refers to the amount of protein required to have an insecticidal effect. Therefore, when a first protein has a higher specific activity than a second protein it takes a lesser amount of the first protein compared to the second protein to have an insecticidal effect on the same percentage of exposed insects. One measure of specific activity is the lethal concentration of a polypeptide it takes to kill 50% of the exposed insects (i.e. LC50). A first polypeptide with a lower LC50 than a second polypeptide has a higher specific activity than the second polypeptide.

Different nucleic acids or polypeptides having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins.

As used herein "sequence identity" refers to the extent to which two optimally aligned polynucleotide or peptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data*, Part I (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear nucleotide sequence of a reference ("query") polynucleotide (or its complementary strand) as compared to a test ("subject") polynucleotide (or its complementary strand) when the two sequences are optimally aligned (with appropriate nucleotide insertions, deletions, or gaps totaling less than 20 percent of the reference sequence over the window of comparison). In some embodiments, "percent identity" can refer to the percentage of identical amino acids in an amino acid sequence.

As used herein, the phrase "substantially identical," in the context of two nucleic acid or protein sequences, refers to two or more sequences or subsequences that have at least 60%, at least 70%, at least 75%, at least 80%, at least 85%, at least 90%, at least 95%, or at least 99% nucleotide or amino acid residue identity, when compared and aligned for maximum correspondence, as measured using one of the following sequence comparison algorithms or by visual inspection. In some embodiments of the invention, the substantial identity exists over a region of the sequences that is at least about 50 residues to about 150 residues in length. Thus, in some embodiments of this invention, the substantial identity exists over a region of the sequences that is at least about 50, about 60, about 70, about 80, about 90, about 100, about 110, about 120, about 130, about 140, about 150, or more residues in length. In some particular embodiments, the sequences are substantially identical over at least about 150 residues. In a further embodiment, the sequences are substantially identical over the entire length of the coding regions. Furthermore, substantially identical nucleotide or protein sequences perform substantially the same function.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more nucleotide sequences may be to a full-length nucleotide sequence or a portion thereof, or to a longer nucleotide sequence. For purposes of this invention "percent identity" may also be determined using BLASTX version 2.0 for translated nucleotide sequences and BLASTN version 2.0 for nucleotide sequences.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89: 10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleotide sequence to the reference nucleotide sequence is less than about 0.1 to less than about 0.001. Thus, in some embodiments of the invention, the smallest sum probability in a comparison of the test nucleotide sequence to the reference nucleotide sequence is less than about 0.001.

Another indication that two nucleic acid sequences are substantially identical is that the two molecules hybridize to each other under stringent conditions. The phrase "hybridizing specifically to" refers to the binding, duplexing, or hybridizing of a molecule only to a particular polynucleotide under stringent conditions when that polynucleotide is present in a complex mixture (e.g., total cellular) of DNA or of RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

"Stringent hybridization conditions" and "stringent hybridization wash conditions" in the context of nucleic acid hybridization experiments such as Southern and Northern hybridizations are sequence dependent, and are different under different environmental parameters. Polynucleotides with longer sequences hybridize specifically at higher temperatures. An extensive guide to the hybridization of nucleic acids is found in Tijssen *Laboratory Techniques in Biochemistry and Molecular Biology-Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH. Typically, under "stringent conditions" a probe will hybridize to its target subsequence, but to no other sequences.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleic acids which have more than 100 complementary residues on a filter in a Southern or northern blot is 50% formamide with 1 mg of heparin at 42° C., with the hybridization being carried out overnight. An example of highly stringent wash conditions is 0.1 5 M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization.

The following are examples of sets of hybridization/wash conditions that may be used to clone homologous polynucleotides that are substantially identical to reference polynucleotides of the invention. In one embodiment, a reference polynucleotide hybridizes to the "test" polynucleotide in 7% sodium dodecyl sulfate (SDS), 0.5 M $NaPO_4$, 1 mM EDTA at 50° C. with washing in 2×SSC, 0.1% SDS at 50° C. In another embodiment, the reference polynucleotide hybridizes to the "test" polynucleotide in 7% sodium dodecyl sulfate (SDS), 0.5 M $NaPO_4$, 1 mM EDTA at 50° C. with washing in 1×SSC, 0.1% SDS at 50° C. or in 7% sodium dodecyl sulfate (SDS), 0.5 M $NaPO_4$, 1 mM EDTA at 50° C. with washing in 0.5×SSC, 0.1% SDS at 50° C. In still further embodiments, the reference polynucleotide hybridizes to the "test" polynucleotide in 7% sodium dodecyl sulfate (SDS), 0.5 M $NaPO_4$, 1 mM EDTA at 50° C. with washing in 0.1×SSC, 0.1% SDS at 50° C., or in 7% sodium dodecyl sulfate (SDS), 0.5 M $NaPO_4$, 1 mM EDTA at 50° C. with washing in 0.1×SSC, 0.1% SDS at 65° C.

A further indication that two polynucleotides or two polypeptide sequences are substantially identical is that the protein encoded by the first nucleic acid is immunologically cross reactive with, or specifically binds to, the protein encoded by the second nucleic acid. Thus, a polypeptide is typically substantially identical to a second polypeptide, for example, where the two polypeptides differ only by conservative substitutions.

As used herein, "synthetic" refers to a polynucleotide or nucleotide sequence comprising structural characters that are not present in the natural polynucleotide or nucleotide sequence. For example, an artificial sequence that resembles more closely the G+C content and the normal codon distribution of dicot and/or monocot genes is said to be synthetic.

A "Vip3 polypeptide" in the context of the invention means a vegetative insecticidal protein (VIP) that is a member of the Vip3 class including for example without limitation, Vip3Aa1, Vip3Aa2, Vip3Aa3, Vip3Aa19, Vip3Aa20, Vip3Af1, Vip3Af2, Vip3Ag1, and their homologues. Some structural features that identify a protein as being in the Vip3 class of proteins includes, 1) a size of about 80-88 kDa that is proteolytically processed by insects or trypsin to about a 62-66 kDa toxic core (Lee et al. 2003. Appl. Environ. Microbiol. 69:4648-4657); and 2) a highly conserved N-terminal secretion signal which is not naturally processed during secretion in *B. thuringiensis* and that comprises the amino acid sequence IYGFATGIKDI (SEQ ID NO:114). Non-limiting examples of members of the Vip3 class including those previously mentioned and their respective GenBank accession numbers, U.S. patent or patent publication number are Vip3Aa1 (AAC37036), Vip3Aa2 (AAC37037), Vip3Aa3 (U.S. Pat. No. 6,137,033), Vip3Aa4 (AAR81079), Vip3Aa5 (AAR81080), Vip3Aa6 (AAR81081), Vip3Aa7 (AAK95326), Vip3Aa8 (AAK97481), Vip3Aa9 (CAA76665), Vip3Aa10 (AAN60738), Vip3Aa11 (AAR36859), Vip3Aa12 (AAM22456), Vip3Aa13 (AAL69542), Vip3Aa14 (AAQ12340), Vip3Aa15 (AAP51131), Vip3Aa16 (AAW65132), Vip3Aa17 (U.S. Pat. No. 6,603,063), Vip3Aa18 (AAX49395), Vip3Aa19 (DQ241674), Vip3Aa19 (DQ539887), Vip3Aa20 (DQ539888), Vip3Aa21 (ABD84410), Vip3Aa22 (AAY41427), Vip3Aa23 (AAY41428), Vip3Aa24 (BI 880913), Vip3Aa25 (EF608501), Vip3Aa26 (EU294496), Vip3Aa27 (EU332167), Vip3Aa28 (FJ494817), Vip3Aa29 (FJ626674), Vip3Aa30 (FJ626675), Vip3Aa31 (FJ626676), Vip3Aa32 (FJ626677), Vip3Aa33 (GU073128), Vip3Aa34 (GU073129), Vip3Aa35 (GU733921), Vip3Aa36 (GU951510), Vip3Aa37 (HM132041), Vip3Aa38 (HM117632), Vip3Aa39 (HM117631), Vip3Aa40 (HM132042), Vip3Aa41 (HM132043), Vip3Aa42 (HQ587048), Vip3Aa43 (HQ594534), Vip3Aa44 (HQ650163), Vip3Ab1 (AAR40284), Vip3Ab2 (AAY88247), Vip3Ac1 (U.S. Patent Application Publication 20040128716), Vip3Ad1 (U.S. Patent Application Publication 20040128716), Vip3Ad2 (CAI43276), Vip3Ae1 (CAI43277), Vip3Af1 (U.S. Pat. No. 7,378,493), Vip3Af2 (ADN08753), Vip3Af3 (HM117634), Vip3Ag1 (ADN08758), Vip3Ag2 (FJ556803), Vip3Ag3 (HM117633), Vip3Ag4 (HQ414237), Vip3Ag5 (HQ542193), Vip3Ah1 (DQ832323), Vip3Ba1 (AAV70653), Vip3Ba2 (HM117635), Vip3Bb1 (U.S. Pat. No. 7,378,493), Vip3Bb2 (AB030520) and Vip3Bb3 (ADI48120).

"Homologue" is used herein to mean that the indicated polypeptide bears a defined relationship to other members of the Vip3 class of polypeptides. This defined relationship includes but is not limited to: (1) polypeptides which are at least about 70% to at least about 90% (e.g., 70%, 71%, 72%, 73%, 74%, 75%, 76%, 77%, 78%, 79%, 80%, 81%, 82%, 83%, 84%, 85%, 86%, 87%, 88%, 89%, 90% 91%, 92%, 93%, 94%, 95%, 96%, 97%, 98%, 99%, 100%) identical at the sequence level to another member of the Vip3 class of polypeptides while also retaining pesticidal activity; (2) polypeptides which are cross-reactive to antibodies which immunologically recognize another member of the Vip3 class of polypeptides, (3) polypeptides which are cross-reactive with a receptor to another member of the Vip3 class of polypeptides and retain the ability to induce programmed cell death, and (4) polypeptides which are at least about 70% to at least about 90% (e.g., 70%, 71%, 72%, 73%, 74%, 75%, 76%, 77%, 78%, 79%, 80%, 81%, 82%, 83%, 84%, 85%, 86%, 87%, 88%, 89%, 90% 91%, 92%, 93%, 94%, 95%, 96%, 97%, 98%, 99%, 100%) identical at the sequence level to the toxic core region of another member of the Vip3 class of polypeptides while also retaining pesticidal activity. Vip3 homologues have been disclosed in WO 98/18932, WO 98/33991, WO 98/00546, and WO 99/57282.

Thus, in some embodiments of the invention, the polypeptides are at least 70% identical at the sequence level to another member of the Vip3 class of polypeptides and/or to the toxic core region of another member of the Vip3 class of polypeptides, while also retaining pesticidal activity. In other embodiments of the invention, the polypeptides are at least 80% identical at the sequence level to another member of the Vip3 class of polypeptides and/or to the toxic core region of another member of the Vip3 class of polypeptides, while also retaining pesticidal activity. In still other embodiments, the polypeptides are at least 90% identical at the sequence level to another member of the Vip3 class of polypeptides and/or to the toxic core region of another member of the Vip3 class of polypeptides, while also retaining pesticidal activity.

Nucleotides are indicated by their bases by the following standard abbreviations: adenine (A), cytosine (C), thymine (T), and guanine (G) Amino acids are likewise indicated by the following standard abbreviations: alanine (Ala; A), arginine (Arg; R), asparagine (Asn; N), aspartic acid (Asp; D), cysteine (Cys; C), glutamine (Gln; Q), glutamic acid (Glu; E), glycine (Gly; G), histidine (H is; H), isoleucine (Ile; 1), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

The invention is based on the discovery that substituting amino acid residues at particular positions identified in a Vip3 polypeptide can alter the pesticidal (e.g., insecticidal) activity of the Vip3 polypeptide in terms of the level of toxicity toward a cell and/or organism against which the Vip3 polypeptide is known to have activity and/or in terms of the particular population that is affected by the polypeptide (e.g., wherein, the species specificity of the polypeptide activity can be modified). Thus, the invention provides modified Vip3 polypeptides and methods of producing and using the modified polypeptides.

Accordingly, in one embodiment of the invention an engineered polypeptide having pesticidal activity (e.g., insecticidal) against at least *Ostrinia nubilalis* (European corn borer, ECB) is provided, wherein the polypeptide comprises an amino acid sequence having at least 95% (e.g., 95%, 96%, 97%, 98%, 99%, 99.1%, 99.2%, 99.3%, 99.4%, 99.5%, 99.6%, 99.7%, 99.8%, 99.9%) identity to the amino acid sequence of SEQ ID NO: 1 (Vip3D) and further comprises at least one (e.g., 1, 2, 3, 4, 5, 6, 7, 8, 9, 10, and the like) amino acid mutation at a position that corresponds to a position identified in Table 1, set forth below, or any combination thereof, wherein the mutation improves pesticidal activity against at least *Ostrinia nubilalis* (European corn borer, ECB) compared to the ECB activity of a wild-type polypeptide from which the engineered polypeptide is derived (e.g. SEQ ID NO: 1 (Vip3D)). In a further embodiment of the invention, an engineered polypeptide having pesticidal activity (e.g., insecticidal) against at least *Ostrinia nubilalis* (European corn borer, ECB) is provided, wherein the polypeptide comprises an amino acid sequence having at least 95% (e.g., 95%, 96%, 97%, 98%, 99%, 99.1%, 99.2%, 99.3%, 99.4%, 99.5%, 99.6%, 99.7%, 99.8%, 99.9%) identity to the amino acid sequence of SEQ ID NO: 1 (Vip3D) and further comprises at least one amino acid mutation at a position identified in Table 1, set forth below, or any combination thereof, wherein the mutation improves pesticidal activity against at least *Ostrinia nubilalis* (European corn borer, ECB) compared to the ECB activity of a wild-type polypeptide from which the engineered polypeptide is derived (e.g. SEQ ID NO: 1 (Vip3D)).

According to another embodiment, the invention includes a modified Vip3 polypeptide comprising a mutation that corresponds to or is at one or more positions disclosed in Table 1, wherein the modified Vip3 polypeptide has a higher specific activity against a target insect pest compared to an unmodified Vip3 polypeptide.

polypeptide from which the engineered polypeptide is derived (e.g., SEQ ID NO:1). In other embodiments, the at least one amino acid mutation is at position S200, A257, K284, V358, D660, K661, L665, P669, A670, N682, I685, T687, A690, F698, G702, S710, A725, S726, F729, N730, R743, N745, S751, H752, G755, K758, G776, V785, M362, F581, T633, T663, D672, G689, I699, N700, N704, T706, F707, R708, S712, Y716, S720, T732, V733, S749, I753, N762, N763, T764, G765, L766, V768, R772, G778, I780, N784, K668, P681, S683, T686, P688, S691, K696, L701, T703, N714, I721, S722, T724, P728, S744, L746, M747, S748, T750, T756, E760, S761, R773, S774, G775, H779, S781, E783, N312, V338, D342, M347, H355, V372, E374, N380, V391, I392, F400, V415, D426, K432, T433, V438, E449, K455, R465, N470, D471, V480, L494, Q495, A496, R501, I503, T504, L514, S532, S543, I544, E546, D547,

TABLE 1

Positions for amino acid mutations in the engineered polypeptide of claim 1. Numbering of the amino acid residues is based on the amino acid sequence of SEQ ID NO: 1 (Vip3D).

Essential

| S200 | A257 | K284 | V358 | M362 | F581 | T633 | T663 | D672 | G689 | I699 | N700 |
|------|------|------|------|------|------|------|------|------|------|------|------|
| N704 | T706 | F707 | R708 | S712 | Y716 | S720 | T732 | V733 | S749 | I753 | N762 |
| N763 | T764 | G765 | L766 | V768 | R772 | G778 | I780 | N784 | | | |

Synergist

| K668 | P681 | S683 | T686 | P688 | S691 | K696 | L701 | T703 | N714 | I721 | S722 |
|------|------|------|------|------|------|------|------|------|------|------|------|
| T724 | P728 | S744 | L746 | M747 | S748 | T750 | T756 | E760 | S761 | R773 | S774 |
| G775 | H779 | S781 | E783 | | | | | | | | |

Cryptic Synergist

| N312 | V338 | D342 | M347 | H355 | V372 | E374 | N380 | V391 | I392 | F400 | V415 |
|------|------|------|------|------|------|------|------|------|------|------|------|
| D426 | K432 | T433 | V438 | E449 | K455 | R465 | N470 | D471 | V480 | L494 | Q495 |
| A496 | R501 | I503 | T504 | L514 | S532 | S543 | I544 | E546 | D547 | G580 | P591 |
| T600 | P605 | H608 | N613 | T614 | Y616 | I617 | H618 | N625 | Y629 | R635 | T637 |
| L642 | K643 | L649 | K650 | W658 | D660 | K661 | L665 | P669 | A670 | N682 | I685 |
| T687 | A690 | F698 | G702 | S710 | A725 | S726 | F729 | N730 | R743 | N745 | S751 |
| H752 | G755 | K758 | G776 | V785 | | | | | | | |

Accordingly, in some embodiments, an engineered polypeptide is provided that comprises an amino acid sequence having at least 95% (e.g., 95%, 96%, 97%, 98%, 99%, 99.1%, 99.2%, 99.3%, 99.4%, 99.5%, 99.6%, 99.7%, 99.8%, 99.9%) identity to the amino acid sequence of SEQ ID NO:1 (Vip3D) and further comprises at least one amino acid mutation at a position that corresponds to an amino acid position of S200, A257, K284, V358, D660, K661, L665, P669, A670, N682, I685, T687, A690, F698, G702, S710, A725, S726, F729, N730, R743, N745, S751, H752, G755, K758, G776, V785, M362, F581, T633, T663, D672, G689, I699, N700, N704, T706, F707, R708, S712, Y716, S720, T732, V733, S749, I753, N762, N763, T764, G765, L766, V768, R772, G778, I780, N784, K668, P681, S683, T686, P688, S691, K696, L701, T703, N714, I721, S722, T724, P728, S744, L746, M747, S748, T750, T756, E760, S761, R773, S774, G775, H779, S781, E783, N312, V338, D342, M347, H355, V372, E374, N380, V391, I392, F400, V415, D426, K432, T433, V438, E449, K455, R465, N470, D471, V480, L494, Q495, A496, R501, I503, T504, L514, S532, S543, I544, E546, D547, G580, P591, T600, P605, H608, N613, T614, Y616, I617, H618, N625, Y62P, R635, T637, L642, K643, L649, K650, W658, or any combination thereof, in the amino acid sequence of SEQ ID NO:1, wherein the mutation improves pesticidal (i.e., insecticidal) activity against at least *Ostrinia nubilalis* (European corn borer, ECB) compared to the ECB activity of the wild-type polypeptide from which the engineered polypeptide is derived (e.g., SEQ ID NO:1). In still further embodiments, an engineered polypeptide is provided that comprises an amino acid sequence having at least 95% identity to the amino acid sequence of SEQ ID NO:1 (Vip3D) and further comprises at least one amino acid mutation that is a mutation that corresponds to or is a mutation of V338A, V338N, V338T, V338P, V338G, G580, P591, T600, P605, H608, N613, T614, Y616, I617, H618, N625, Y62P, R635, T637, L642, K643, L649, K650, W658, or any combination thereof, in the amino acid sequence of SEQ ID NO:1, wherein the mutation improves pesticidal (i.e., insecticidal) activity against at least *Ostrinia nubilalis* (European corn borer, ECB) compared to the ECB activity of the wild-type polypeptide (SEQ ID NO:1).

In other embodiments, the invention provides an engineered polypeptide that comprises an amino acid sequence having at least 95% (e.g., 95%, 96%, 97%, 98%, 99%, 99.1%, 99.2%, 99.3%, 99.4%, 99.5%, 99.6%, 99.7%, 99.8%, 99.9%) identity to the amino acid sequence of SEQ ID NO:1 (Vip3D) and further comprises at least one amino acid mutation at a position that corresponds to or is at an amino acid position of V338, K455, R465, S532, I544, G580, S712, E760, L766, V768 and/or any combination thereof, in SEQ ID NO:1, wherein the mutation improves pesticidal activity against at least *Ostrinia nubilalis* (European corn borer, ECB) compared to the ECB activity of the wild-type polypeptide from which the engineered polypeptide is derived (e.g., SEQ ID NO:1).

V338W, V338Y, V338S, V338L, V338K, V338I, V338M, V338E, V338C, V338Q, V338F, V338D, K455A, K455N, K455T, K455G, K455I, K455E, R465A, R465N, V465T, V465P, V465G, V465W, V465Y, V465S, V465L, V465K, V465I, V465M, V465E, V465C, V465Q, V465F, V465D, D471A, D471N, D471T, D471I, D471Q, D471V, S532A, S532N, S532Y, S532K, S532M, S532C, S532D, I544A, I544N, H608A, H608L, Y629A, Y629W, Y629S, Y629K, Y629E, Y629Q, Y629F, R635A, R635S, K643A, K643S, L649A, L649W, L649S, L649R, S683A, S683N, S683Y, S683K, S683M, S683C, S683D, M747A, M747W, M747Y, M747S, M747K, M747E, M747C, M747Q, L766A, L766T, L766P, L766G, L766W, L766S, L766K, L766I, L766M, L766E, L766C, L766F, L766R, G580A, G580N, G580T, G580P, G580W, G580Y, G580S, G580K, G580M, G580C, G580H, G580L, G580E, K650A, K650N, or any combination thereof, in the amino acid sequence of SEQ ID NO:1, wherein the mutation improves pesticidal (i.e., insecticidal) activity against at least *Ostrinia nubilalis* (European corn borer, ECB) compared to the ECB activity of the wild-type polypeptide from which the engineered polypeptide is derived (e.g., SEQ ID NO:1).

In additional embodiments, an engineered polypeptide is provided that comprises an amino acid sequence having at least 95% identity to the amino acid sequence of SEQ ID NO:1 (Vip3D) and further comprises amino acid mutations that correspond to the amino acid mutations of: a mutation at I544A and at S712A, a mutation at K455A and at V338A, a mutation at H618A and at T750A, a mutation at L701A and at I721A, a mutation at S722A and at S781A, a mutation at S761A and at S744A, a mutation at S781A and at S744A, and a mutation at S781A and at T750A, in the amino acid sequence of SEQ ID NO:1, wherein the mutation improves pesticidal (i.e., insecticidal) activity against at least *Ostrinia nubilalis* (European corn borer, ECB) compared to the ECB activity of the wild-type polypeptide from which the engineered polypeptide is derived (e.g., SEQ ID NO:1).

In other embodiments, an engineered polypeptide is provided that comprises an amino acid sequence having at least 95% identity to the amino acid sequence of SEQ ID NO:1 (Vip3D) and further comprises at least two (e.g., 2, 3, 4, 5, 6, 7, 8, 9, 10, and the like) amino acid mutations that are the amino acid mutations of I544A and S712A, K455A and V338A, H618A and T750A, L701A and I721A, S722A and S781A, S761A and S744A, S781A and S744A, or S781A and T750A, in the amino acid sequence of SEQ ID NO:1, wherein the mutation improves pesticidal (i.e., insecticidal) activity against at least *Ostrinia nubilalis* (European corn borer, ECB) compared to the ECB activity of the wild-type polypeptide from which the engineered polypeptide is derived (e.g., SEQ ID NO:1).

Of course, one of skill in the art will realize that these amino acid modifications need not be made in the polypeptides themselves (although chemical synthesis of such polypeptides is well-known to those of skill in the art), but may also be made via mutagenesis of a polynucleotide which encodes such a polypeptide. Means for such polynucleotide mutagenesis are described herein in detail, and exemplary polypeptides constructed using such methods are described in detail in the Examples which follow herein.

In further embodiments, the invention provides a recombinant nucleic acid molecule comprising a nucleotide sequence encoding a polypeptide of the invention. In some embodiments, the nucleotide sequence encoding a polypeptide of the invention includes, but is not limited to, the nucleotide sequence of SEQ ID NO:4, the nucleotide sequence of SEQ ID NO:6, the nucleotide sequence of SEQ ID NO:8, the nucleotide sequence of SEQ ID NO:10, the nucleotide sequence of SEQ ID NO:12, the nucleotide sequence of SEQ ID NO:14, the nucleotide sequence of SEQ ID NO:19, the nucleotide sequence of SEQ ID NO:21, the nucleotide sequence of SEQ ID NO:23, the nucleotide sequence of SEQ ID NO:25, the nucleotide sequence of SEQ ID NO:27, the nucleotide sequence of SEQ ID NO:29, the nucleotide sequence of SEQ ID NO:31, the nucleotide sequence of SEQ ID NO:33, the nucleotide sequence of SEQ ID NO:35, the nucleotide sequence of SEQ ID NO:37, the nucleotide sequence of SEQ ID NO:39, the nucleotide sequence of SEQ ID NO:41, the nucleotide sequence of SEQ ID NO:43, the nucleotide sequence of SEQ ID NO:45, the nucleotide sequence of SEQ ID NO:47, the nucleotide sequence of SEQ ID NO:49, the nucleotide sequence of SEQ ID NO:51, the nucleotide sequence of SEQ ID NO:53, the nucleotide sequence of SEQ ID NO:55, the nucleotide sequence of SEQ ID NO:57, the nucleotide sequence of SEQ ID NO:59, the nucleotide sequence of SEQ ID NO:61, the nucleotide sequence of SEQ ID NO:63, the nucleotide sequence of SEQ ID NO:65, the nucleotide sequence of SEQ ID NO:67, the nucleotide sequence of SEQ ID NO:69, the nucleotide sequence of SEQ ID NO:71, the nucleotide sequence of SEQ ID NO:73, the nucleotide sequence of SEQ ID NO:75, the nucleotide sequence of SEQ ID NO:77, the nucleotide sequence of SEQ ID NO:79, the nucleotide sequence of SEQ ID NO:81, the nucleotide sequence of SEQ ID NO:83, the nucleotide sequence of SEQ ID NO:85, the nucleotide sequence of SEQ ID NO:87, the nucleotide sequence of SEQ ID NO:89, the nucleotide sequence of SEQ ID NO:91, the nucleotide sequence of SEQ ID NO:93, the nucleotide sequence of SEQ ID NO:95, the nucleotide sequence of SEQ ID NO:97, the nucleotide sequence of SEQ ID NO:99, the nucleotide sequence of SEQ ID NO:101, the nucleotide sequence of SEQ ID NO:103, the nucleotide sequence of SEQ ID NO:105, the nucleotide sequence of SEQ ID NO:107, the nucleotide sequence of SEQ ID NO:109, the nucleotide sequence of SEQ ID NO:111, the nucleotide sequence of SEQ ID NO:113, the nucleotide sequence of SEQ ID NO:116, the nucleotide sequence of SEQ ID NO:118, the nucleotide sequence of SEQ ID NO:120, the nucleotide sequence of SEQ ID NO:122, the nucleotide sequence of SEQ ID NO:124, the nucleotide sequence of SEQ ID NO:126, the nucleotide sequence of SEQ ID NO:128, the nucleotide sequence of SEQ ID NO:130, or any combination thereof.

In still further embodiments, the invention provides a recombinant nucleic acid molecule comprising a nucleotide sequence encoding an engineered polypeptide of the invention.

In some embodiments, the invention provides a recombinant nucleic acid molecule comprising a nucleotide sequence encoding the amino acid sequence of SEQ ID NO:3, the amino acid sequence of SEQ ID NO:5, the amino acid sequence of SEQ ID NO:7, the amino acid sequence of SEQ ID NO:9, the amino acid sequence of SEQ ID NO:11, the amino acid sequence of SEQ ID NO:13, the amino acid sequence of SEQ ID NO:18, the amino acid sequence of SEQ ID NO:20, the amino acid sequence of SEQ ID NO:22, the amino acid sequence of SEQ ID NO:24, the amino acid sequence of SEQ ID NO:26, the amino acid sequence of SEQ ID NO:28, the amino acid sequence of SEQ ID NO:30, the amino acid sequence of SEQ ID NO:32, the amino acid sequence of SEQ ID NO:34, the amino acid sequence of SEQ ID NO:36, the amino acid sequence of SEQ ID NO:38, the amino acid sequence of SEQ ID NO:40, the amino acid sequence of SEQ ID NO:42, the amino acid sequence of SEQ ID NO:44, the amino acid sequence of SEQ ID NO:46, the amino acid sequence of SEQ ID NO:48, the amino acid sequence of SEQ ID NO:50, the amino acid sequence of SEQ ID NO:52, the amino acid sequence of SEQ ID NO:54, the amino acid sequence of SEQ ID NO:56, the amino acid sequence of SEQ ID NO:58, the amino acid sequence of SEQ ID NO:60, the amino acid sequence of SEQ ID NO:62, the amino acid sequence of SEQ ID NO:64, the amino acid sequence of SEQ ID NO:66, the amino acid sequence of SEQ ID NO:68, the amino acid sequence of SEQ ID NO:70, the amino acid sequence of SEQ ID NO:72, the amino acid sequence of SEQ ID NO:74, the amino acid sequence of SEQ ID NO:76, the amino acid sequence of SEQ ID NO:78, the amino acid sequence of SEQ ID NO:80, the amino acid sequence of SEQ ID NO:82, the amino acid sequence of SEQ ID NO:84, the amino acid sequence of SEQ ID NO:86, the amino acid sequence of SEQ ID NO:88, the amino acid sequence of SEQ ID NO:90, the amino acid sequence of SEQ ID NO:92, the amino acid sequence of SEQ ID NO:94, the amino acid sequence of SEQ ID NO:96, the amino acid sequence of SEQ ID NO:98, the amino acid sequence of SEQ ID NO:100, the amino acid sequence of SEQ ID NO:102, the amino acid sequence of SEQ ID NO:104, the amino acid sequence of SEQ ID NO:106, the amino acid sequence of SEQ ID NO:108, the amino acid sequence of SEQ ID NO:110, the amino acid sequence of SEQ ID NO:112, the amino acid sequence of SEQ ID NO:115, the amino acid sequence of SEQ ID NO:117, the amino acid sequence of SEQ ID NO:119, the amino acid sequence of SEQ ID NO:121, the amino acid sequence of SEQ ID NO:123, the amino acid sequence of SEQ ID NO:125, the amino acid sequence of SEQ ID NO:127, the amino acid sequence of SEQ ID NO:129, or any combination thereof.

In other embodiments, a recombinant nucleic acid molecule of this invention comprises a nucleotide sequence of SEQ ID NO:4, the nucleotide sequence of SEQ ID NO:6, the nucleotide sequence of SEQ ID NO:8, the nucleotide sequence of SEQ ID NO:10, the nucleotide sequence of SEQ ID NO:12, the nucleotide sequence of SEQ ID NO:14, the nucleotide sequence of SEQ ID NO:19, the nucleotide sequence of SEQ ID NO:21, the nucleotide sequence of SEQ ID NO:23, the nucleotide sequence of SEQ ID NO:25, the nucleotide sequence of SEQ ID NO:27, the nucleotide sequence of SEQ ID NO:29, the nucleotide sequence of SEQ ID NO:31, the nucleotide sequence of SEQ ID NO:33, the nucleotide sequence of SEQ ID NO:35, the nucleotide sequence of SEQ ID NO:37, the nucleotide sequence of SEQ ID NO:39, the nucleotide sequence of SEQ ID NO:41, the nucleotide sequence of SEQ ID NO:43, the nucleotide sequence of SEQ ID NO:45, the nucleotide sequence of SEQ ID NO:47, the nucleotide sequence of SEQ ID NO:49, the nucleotide sequence of SEQ ID NO:51, the nucleotide sequence of SEQ ID NO:53, the nucleotide sequence of SEQ ID NO:55, the nucleotide sequence of SEQ ID NO:57, the nucleotide sequence of SEQ ID NO:59, the nucleotide sequence of SEQ ID NO:61, the nucleotide sequence of SEQ ID NO:63, the nucleotide sequence of SEQ ID NO:65, the nucleotide sequence of SEQ ID NO:67, the nucleotide sequence of SEQ ID NO:69, the nucleotide sequence of SEQ ID NO:71, the nucleotide sequence of SEQ ID NO:73, the nucleotide sequence of SEQ ID NO:75, the nucleotide sequence of SEQ ID NO:77, the nucleotide sequence of SEQ ID NO:79, the nucleotide sequence of SEQ ID NO:81, the nucleotide sequence of SEQ ID NO:83, the nucleotide sequence of SEQ ID NO:85, the nucleotide sequence of SEQ ID NO:87, the nucleotide sequence of SEQ ID NO:89, the nucleotide sequence of SEQ ID NO:91, the nucleotide sequence of SEQ ID NO:93, the nucleotide sequence of SEQ ID NO:95, the nucleotide sequence of SEQ ID NO:97, the nucleotide sequence of SEQ ID NO:99, the nucleotide sequence of SEQ ID NO:101, the nucleotide sequence of SEQ ID NO:103, the nucleotide sequence of SEQ ID NO:105, the nucleotide sequence of SEQ ID NO:107, the nucleotide sequence of SEQ ID NO:109, the nucleotide sequence of SEQ ID NO:111, the nucleotide sequence of SEQ ID NO:113, the nucleotide sequence of SEQ ID NO:116, the nucleotide sequence of SEQ ID NO:118, the nucleotide sequence of SEQ ID NO:120, the nucleotide sequence of SEQ ID NO:122, the nucleotide sequence of SEQ ID NO:124, the nucleotide sequence of SEQ ID NO:126, the nucleotide sequence of SEQ ID NO:128, the nucleotide sequence of SEQ ID NO:130, or any combination thereof.

In some embodiments, the expression of the nucleic acid molecule of the invention results in polypeptides that can be used to control lepidopteran insects that include, but are not limited to, *Ostrinia nubilalis* (European corn borer), *Plutella xylostella* (diamondback moth), *Spodoptera frugiperda* (fall armyworm), *Agrotis ipsilon* (black cutworm), *Agrotis orthogonia* (pale western cutworm), *Striacosta albicosta* (western bean cutworm), *Helicoverpa zea* (corn earworm), *Heliothis virescens* (tobacco budworm), *Spodoptera exigua* (beet armyworm), *Helicoverpa punctigera* (native budworm), *Helicoverpa armigera* (cotton bollworm), *Manduca sexta* (tobacco hornworm), *Trichoplusia ni* (cabbage looper), *Pectinophora gossypiella* (pink bollworm), *Diatraea grandiosella* (southwestern corn borer), *Diatraea saccharalis* (sugarcane borer), *Elasmopalpus lignosellus* (lesser cornstalk borer), *Psuedoplusia includens* (soybean looper), *Anticarsia gemmatalis* (velvetbean caterpillar), *Plathypena scabra* (green cloverworm), and *Cochylis hospes* (banded sunflower moth).

In other embodiments, the expression of the nucleic acid molecule of the invention results in polypeptides that can be used to control nematode pests that include, but are not limited to, *Meloidogyne* spp. (for example, *Meloidogyne incoginita* and *Meloidogyne javanica*, *Meloidogyne hapla*, *Meloidogyne arenari*), *Heterodera* spp. (for example, *Heterodera glycines*, *Heterodera carotae*, *Heterodera schachtii*, *Heterodora avenae* and *Heterodora trifolii*), *Globodera* spp. (for example, *Globodera rostochiensis*), *Radopholus* spp. (for example, *Radopholus similes*), *Rotylenchulus* spp., *Pratylenchus* spp. (for example, *Pratylenchus neglectans* and *Pratylenchus penetrans*), *Aphelenchoides* spp., *Helicotylenchus* spp., *Hoplolaimus* spp., *Paratrichodorus* spp., *Longidorus* spp., *Nacobbus* spp., *Subanguina* spp. *Belonlaimus* spp., *Criconemella* spp., *Criconemoides* spp. *Ditylenchus* spp., *Ditylenchus dipsaci*, *Dolichodorus* spp., *Hemicriconemoides* spp., *Hemicycliophora* spp., *Hirschmaniella* spp., *Hypsoperine* spp., *Macroposthonia* spp., *Melinius* spp., *Punctodera* spp., *Quinisulcius* spp., *Scutellonema* spp., *Xiphinema* spp., *Tylenchorhynchus* spp. and/or any combination thereof.

In other embodiments, the nucleic acid molecule further comprises a heterologous promoter sequence operatively linked to the nucleotide sequence of the invention. Thus, as an example, the engineered Vip3 nucleotide sequences of the invention can be operatively fused to a variety of promoters for expression in host cells (e.g., plant cells). The promoters can include, for example, constitutive, inducible, temporally regulated, developmentally regulated, chemically regulated, tissue-preferred and tissue-specific promoters to prepare recombinant DNA molecules, i.e., chimeric genes.

A "promoter" is an untranslated DNA sequence upstream of a coding region that contains the binding site for RNA polymerase and initiates transcription of the DNA. A "promoter region" can also include other elements that act as regulators of gene expression. In particular aspects, a "promoter" useful with this invention is a promoter capable of initiating transcription of a nucleotide sequence in a cell of a plant.

The choice of promoter will vary depending on the temporal and spatial requirements for expression, and also depending on the host cell to be transformed. Thus, for example, expression of the nucleotide sequences of this invention can be in any plant and/or plant part, (e.g., in leaves, in stalks or stems, in ears, in inflorescences (e.g. spikes, panicles, cobs, etc.)), in roots, and/or seedlings, and the like). In many cases, however, protection against more than one type of insect pest is sought, and thus expression in multiple tissues is desirable. Although many promoters from dicotyledons have been shown to be operational in monocotyledons and vice versa, ideally dicotyledonous promoters are selected for expression in dicotyledons, and monocotyledonous promoters for expression in monocotyledons. However, there is no restriction to the provenance of selected promoters; it is sufficient that they are operational in driving the expression of polynucleotides in the desired cell.

Promoters useful with this invention include those that drive expression of a polynucleotide constitutively, those that drive expression when induced, and those that drive expression in a tissue- or developmentally-specific manner. These various types of promoters are known in the art.

Examples of constitutive promoters include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci. USA* 84:5745-5749), Adh promoter (Walker et al. (1987) *Proc. Natl. Acad. Sci. USA* 84:6624-6629), sucrose synthase promoter (Yang & Russell (1990) *Proc. Natl. Acad. Sci. USA* 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and *arabidopsis* (Norris et al. 1993. *Plant Molec. Biol.* 21:895-906). The maize ubiquitin promoter (UbiP) has been developed in transgenic monocot systems and its sequence and vectors constructed for monocot transformation are disclosed in the patent publication EP 0 342 926. The ubiquitin promoter is suitable for the expression of a polynucleotide of the invention in transgenic plants, especially monocotyledons. Further, the promoter expression cassettes described by McElroy et al. (*Mol. Gen. Genet.* 231: 150-160 (1991)) can be easily modified for the expression of the polynucleotide of the invention and are particularly suitable for use in monocotyledonous hosts.

In some embodiments, tissue specific promoters can be used. Tissue specific expression patterns include, but are not limited to, green tissue specific, root specific, stem specific, and flower specific. Promoters suitable for expression in green tissue include many that regulate genes involved in photosynthesis and many of these have been cloned from both monocotyledons and dicotyledons. In one embodiment, a promoter useful with this invention is the maize PEPC promoter from the phosphoenol carboxylase gene (Hudspeth & Grula, *Plant Molec. Biol.* 12:579-589 (1989)). Non-limiting examples of tissue-specific promoters include those associated with genes encoding the seed storage proteins (such as β-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) *Seed Sci. Res.* 1:209-219; as well as EP Patent No. 255378). Tissue-specific or tissue-preferential promoters useful for the expression of polynucleotides encoding the novel pesticidal polypeptides of the invention in plants, particularly maize, are those that direct expression in root, pith, leaf or pollen. Such promoters are disclosed in WO 93/07278, herein incorporated by reference in its entirety. Other tissue specific promoters useful with the invention include the cotton rubisco promoter disclosed in U.S. Pat. No. 6,040,504; the rice sucrose synthase promoter disclosed in U.S. Pat. No. 5,604,121; the root specific promoter described by de Framond (FEBS 290:103-106 (1991); EP 0 452 269 to Ciba-Geigy); the stem specific promoter described in U.S. Pat. No. 5,625,136 (to Ciba-Geigy) and which drives expression of the maize trpA gene; and the cestrum yellow leaf curling virus promoter disclosed in WO 01/73087, all incorporated by reference Additional examples of tissue-specific promoters include, but are not limited to, the root-specific promoters RCc3 (Jeong et al. *Plant Physiol.* 153:185-197 (2010)) and RB7 (U.S. Pat. No. 5,459,252), the lectin promoter (Lindstrom et al. (1990) *Der. Genet.* 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), S-adenosyl-L-methionine synthetase (SAMS) Wander Mijnsbrugge et al. (1996) *Plant and Cell Physiology*, 37(8):1108-1115), corn light harvesting complex promoter (Bansal et al. (1992) *Proc. Natl. Acad. Sci. USA* 89:3654-3658), corn heat shock protein promoter (O'Dell et al. (1985) *EMBO J.* 5:451-458; and Rochester et al. (1986) *EMBO J.* 5:451-458), pea small subunit RuBP carboxylase promoter (Cashmore, "Nuclear genes encoding the small subunit of ribulose-1,5-bisphosphate carboxylase" pp. 29-39 In: *Genetic Engineering of Plants* (Hollaender ed., Plenum Press 1983; and Poulsen et al. (1986) *Mol. Gen. Genet.* 205:193-200), Ti plasmid mannopine synthase promoter (Langridge et al. (1989) *Proc. Natl. Acad. Sci. USA* 86:3219-3223), Ti plasmid nopaline synthase promoter (Langridge et al. (1989), supra), petunia chalcone isomerase promoter (van Tunen et al. (1988) *EMBO J.* 7:1257-1263), bean glycine rich protein 1 promoter (Keller et al. (1989) *Genes Dev.* 3:1639-1646), truncated CaMV 35S promoter (O'Dell et al. (1985) *Nature* 313:810-812), potato patatin promoter (Wenzler et al. (1989) *Plant Mol. Biol.* 13:347-354), root cell promoter (Yamamoto et al. (1990) *Nucleic Acids Res.* 18:7449), maize zein promoter (Kriz et al. (1987) *Mol. Gen. Genet.* 207:90-98; Langridge et al. (1983) *Cell* 34:1015-1022; Reina et al. (1990) *Nucleic Acids Res.* 18:6425; Reina et al. (1990) *Nucleic Acids Res.* 18:7449; and Wandelt et al. (1989) *Nucleic Acids Res.* 17:2354), globulin-1 promoter (Belanger et al. (1991) *Genetics* 129:863-872), α-tubulin cab promoter (Sullivan et al. (1989) *Mol. Gen. Genet.* 215:431-440), PEPCase promoter (Hudspeth & Grula (1989) *Plant Mol. Biol.* 12:579-589), R gene complex-associated promoters (Chandler et al. (1989) *Plant Cell* 1:1175-1183), and chalcone synthase promoters (Franken et al. (1991) *EMBO J.* 10:2605-2612). Particularly useful for seed-specific expression is the pea vicilin promoter (Czako et al. (1992) *Mol. Gen. Genet.* 235:33-40; as well as the seed-specific promoters disclosed in U.S. Pat. No. 5,625, 136).

Other useful promoters for expression in mature leaves are those that are switched on at the onset of senescence, such as the SAG promoter from *Arabidopsis* (Gan et al. (1995) *Science* 270:1986-1988).

In addition, promoters functional in plastids can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

In some embodiments of this invention, inducible promoters can be used. Regulation of the expression of polynucleotides of the invention via promoters that are chemically regulated enables, for example, the Vip3 polypeptides to be synthesized only when the crop plants are treated with the inducing chemicals. Examples of inducible promoters include, but are not limited to, tetracycline repressor system promoters, Lac repressor system promoters, copper-inducible system promoters, salicylate-inducible system promoters (e.g., the PR1a system), glucocorticoid-inducible promoters (Aoyama et al. (1997) *Plant* 111:605-612), and ecdysone-inducible system promoters. Other inducible promoters include ABA- and turgor-inducible promoters, the auxin-binding protein gene promoter (Schwob et al. (1993) *Plant J.* 4:423-432), the UDP glucose flavonoid glycosyltransferase promoter (Ralston et al. (1988) *Genetics* 119: 185-197), the MPI proteinase inhibitor promoter (Cordero et al. (1994) *Plant J.* 6:141-150), and the glyceraldehyde-3-phosphate dehydrogenase promoter (Kohler et al. (1995) *Plant Mol. Biol.* 29:1293-1298; Martinez et al. (1989) *J. Mol. Biol.* 208:551-565; and Quigley et al. (1989) *J. Mol. Evol.* 29:412-421). Also included are the benzene sulphonamide-inducible (U.S. Pat. No. 5,364,780) and alcohol-inducible (Int'l Patent Application Publication Nos. WO 97/06269 and WO 97/06268) systems and glutathione S-transferase promoters. Likewise, one can use any of the inducible promoters described in Gatz (1996) *Current Opinion Biotechnol.* 7:168-172 and Gatz (1997) *Annu. Rev. Plant Physiol. Plant Mol. Biol.* 48:89-108. Other chemically inducible promoters useful for directing the expression of genes encoding the novel pesticidal polypeptides of the invention in plants are disclosed in U.S. Pat. No. 5,614,395 herein incorporated by reference in its entirety. Chemical induction of gene expression is also detailed in the published application EP 0 332 104 (to Ciba-Geigy) and U.S. Pat. No. 5,614,395. In some embodiments, a promoter for chemical induction can be the tobacco PR-1a promoter.

Additional aspects of this invention provide polynucleotides of the invention operatively linked to a promoter that is wound inducible or inducible by pathogen/pest attack. Numerous promoters have been described which are expressed at wound sites and/or at the sites of attack. Ideally, such a promoter should be active only locally at the sites of attack, and in this way the pesticidal polypeptides only accumulate in cells that need to synthesize the pesticidal polypeptides to kill the invading pest. Such promoters include, but are not limited to, those described by Stanford et al., *Mol. Gen. Genet.* 215:200-208 (1989), Xu et al. *Plant Molec. Biol.* 22:573-588 (1993), Logemann et al. *Plant Cell* 1:151-158 (1989), Rohrmeier & Lehle, *Plant Molec. Biol.* 22:783-792 (1993), Firek et al. *Plant Molec. Biol.* 22:129-142 (1993), and Warner et al. Plant J. 3:191-201 (1993).

In further embodiments, a nucleic acid molecule of the invention can be comprised within a recombinant vector. Vectors for use in transformation of plants and other organisms are well known in the art.

In still further embodiments, the invention provides transgenic non-human host cell comprising the nucleic acid molecules of the invention. The non-human host cell can include, but is not limited to, a plant cell, a bacterial cell, a yeast cell, or an insect cell. Accordingly, in some embodiments, the invention provides a bacterial cell comprising the nucleic acid molecules of the invention. In a further embodiment, the invention provides a yeast cell comprising the nucleic acid molecules of the invention. In still further embodiments, the invention provides a plant cell comprising the nucleic acid molecules of the invention.

Thus, for example, as biological insect control agents, the pesticidal polypeptides of the invention can be produced by expression of the polynucleotides encoding the polypeptides of the invention in heterologous host cells capable of expressing the polynucleotides. Thus, for example, in one embodiment, a *B. thuringiensis* cell comprising one or more polynucleotides of the invention is provided.

In some embodiments, at least one polynucleotide of the invention is inserted into an expression cassette, comprising the necessary elements for expression of the polynucleotide. An expression cassette can include, but is not limited to, a promoter and termination signals. Expression of a polynucleotide in an expression cassette can be constitutive, or it can be inducible, depending on the choice of promoter, as discussed above. In some embodiments, an inducible promoter that can respond to various types of stimuli to initiate transcription can be used. In some embodiments, a cell in which the pesticidal polypeptide can be expressed is a cell from a microorganism, such as a bacteria or a fungus. In another embodiment, a virus, such as a baculovirus, contains a polynucleotide of the invention in its genome and expresses large amounts of the corresponding pesticidal polypeptide after infection of eukaryotic cells suitable for virus replication and expression of the polynucleotide. The pesticidal polypeptide thus produced can be used as a pesticidal, insecticidal and/or nematicidal agent. Alternatively, baculoviruses engineered to include one or more polynucleotides of this invention can be used to infect insects in vivo and kill them either by expression of the pesticidal polypeptide or by a combination of viral infection and expression of the pesticidal polypeptide.

In another embodiment, a polynucleotide of this invention can be introduced into a non-pathogenic self-replicating virus.

As previously discussed, bacterial cells also can be hosts for the expression of the polynucleotides of the invention. In one embodiment, non-pathogenic symbiotic bacteria, which are able to live and replicate within plant tissues, so-called endophytes, or non-pathogenic symbiotic bacteria that are capable of colonizing the phyllosphere or the rhizosphere, (e.g., epiphytes) can be used. Such bacteria include, but are not limited to, bacteria of the genera *Agrobacterium, Alcaligenes, Azospirillum, Azotobacter, Bacillus, Clavibacter, Enterobacter, Erwinia, Flavobacter, Klebsiella, Pseudomonas, Rhizobium, Serratia, Streptomyces* and *Xanthomonas*. Symbiotic fungi, such as *Trichoderma* and *Gliocladium* also can be hosts for expression of one or more polynucleotides of this invention.

Techniques for the transformation of the various organisms/host cells are known in the art. For example, the expression vectors pKK223-3 and pKK223-2 can be used to express heterologous genes in *E. coli*, either in transcriptional or translational fusion, behind a tac or trc promoter. For the expression of operons encoding multiple ORFs, one procedure is to insert the operon into a vector such as pKK223-3 in transcriptional fusion, allowing the cognate ribosome binding site of the heterologous genes to be used. Techniques for overexpression in gram-positive species such as *Bacillus* are also known in the art and can be used in the context of this invention (Quax et al. In: *Industrial Microorganisms: Basic and Applied Molecular Genetics*, Eds. Baltz et al., American Society for Microbiology, Washington (1993)). Alternate systems for overexpression rely, for example, on yeast vectors and include the use of *Pichia, Saccharomyces* and/or *Kluyveromyces* (Sreekrishna, In: *Industrial Microorganisms Basic and Applied Molecular Genetics*, Baltz, Hegeman, and Skatrud eds., American Society for Microbiology, Washington (1993); Dequin & Barre, *Biotechnology L*2:173-177 (1994); van den Berg et al., *Biotechnology* 8:135-139 (1990)).

In other embodiments, one or more of the pesticidal polypeptides of the invention can be expressed in a higher organism, e.g., a plant. Thus, in some aspects of the invention, a transgenic plant comprising cells that further comprise the polynucleotides and/or the nucleic acid molecules of the invention is provided. Methods of producing transgenic plant cells and transgenic plants are well known in the art, as discussed below.

In some embodiments, transgenic plants expressing effective amounts of the pesticidal polypeptides can protect themselves from insect pests. Thus, when the insect begins to feed on a transgenic plant of this invention, it ingests the expressed polypeptides. Ingesting the pesticidal polypeptide can deter the insect from further biting into the plant tissue or can even harm or kill the insect.

In some embodiments, a polynucleotide of the invention can be stably integrated into the genome of a plant cell, thus stably transforming the plant cell. In some embodiments, wherein a plant cell, plant part, or tissue culture is stably transformed, a stably transformed plant can be regenerated therefrom. In other embodiments of this invention, a plant can be transiently transformed.

"Transformation" is a process for introducing one or more heterologous polynucleotides into a host cell or organism.

"Transient transformation" in the context of a nucleic acid means that a nucleic acid is introduced into the cell and does not integrate into the genome of the cell.

"Stable transformation" or "stably transformed" as used herein means that a nucleic acid that is introduced into a cell and integrates into the genome of the cell. As such, the integrated nucleic acid is capable of being inherited by the progeny thereof, more particularly, by the progeny of multiple successive generations. The genome as used herein also includes the plastid genome, and therefore includes integration of the nucleic acid into, for example, the chloroplast genome. Stable transformation as used herein can also refer to a transgene that is maintained extrachromosomally, for example, as a minichromosome.

By "stably introducing" or "stably introduced" in the context of a nucleic acid introduced into a cell is intended that the introduced nucleic acid is stably incorporated (integrated) into the genome of the cell, and thus the cell is stably transformed with the nucleic acid.

"Introducing" in the context of a polynucleotide of interest means presenting to the plant the polynucleotide in such a manner that the polynucleotide gains access to the interior of a host cell (e.g., plant cell, bacterial cell, fungal cell, and the like). Where more than one polynucleotide is to be introduced, these polynucleotides can be assembled as part of a single polynucleotide or nucleic acid construct, or as separate polynucleotide or nucleic acid constructs, and can be located on the same or different transformation vectors. Further, these polynucleotides can be introduced into cells in a single transformation event, in separate transformation events, or, for example, as part of a breeding protocol.

"Transformed," "transgenic" or "recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. Transformed cells, tissues, or plants are understood to encompass not only the end product of a transformation process, but also transgenic progeny thereof. A "non-transformed", "non-transgenic", or "non-recombinant" host refers to a wild-type organism, e.g., a bacterium or plant, which does not contain a heterologous nucleic acid molecule.

A polynucleotide of this invention can be expressed in transgenic plants resulting in the biosynthesis of the corresponding pesticidal polypeptide in the transgenic plants. In this way, transgenic plants with enhanced resistance to pests (e.g., insects) can be generated. For their expression in transgenic plants, the polynucleotide of the invention may require modification and optimization for expression in a plant. Although in many cases, genes from microbial organisms can be expressed in plants at high levels without modification, low expression in transgenic plants may result from sequences of microbial polynucleotides having codons that are not preferred in plants. It is known in the art that all organisms have specific preferences for codon usage, and the codons of the nucleotide sequences described in this invention can be changed to conform with plant preferences, while maintaining the amino acids encoded thereby. Furthermore, high expression in plants can be achieved from coding sequences that have at least about 35% GC content, more than about 45% GC content, more than about 50% GC content, or more than about 60% GC content. Microbial polynucleotides that have low GC content may express poorly in plants due to the existence of ATTTA motifs that may destabilize messages and AATAAA motifs that may cause inappropriate polyadenylation. Additionally, although a polynucleotide of interest may be adequately expressed in both monocotyledonous and dicotyledonous plant species, a polynucleotide can be modified to account for the specific codon preferences and GC content preferences of monocotyledons or dicotyledons as these preferences have been shown to differ (Murray et al., *Nucl. Acids Res.* 17:477-498 (1989)). In addition, the nucleotide sequences can be screened for the existence of illegitimate splice sites that may cause message truncation. All changes required to be made within the nucleotide sequences such as those described above can be made using well known techniques of site directed mutagenesis, PCR, and/or synthetic gene construction using the methods described in, for example, the published patent applications EP 0 385 962, EP 0 359 4721, and WO 93/07278.

Accordingly, in one embodiment of the invention, a vip3E nucleotide sequence (e.g., SEQ ID NO:4) can be designed and optimized for expression in plants (SEQ ID NO:454) according to the procedure disclosed in U.S. Pat. No. 5,625,136, herein incorporated by reference. In this procedure, maize preferred codons, i.e., the single codon which most frequently encodes that amino acid in maize, are used.

The maize preferred codon for a particular amino acid may be derived, for example, from known gene sequences from maize. Maize codon usage for 28 genes from maize plants is found, for example, in Murray et al. (*Nucleic Acids Research* 17:477-498 (1989)), the disclosure of which is incorporated herein by reference. In this manner, the nucleotide sequences can be optimized for expression in any plant. It is recognized that all or any part of the nucleotide sequence may be optimized or synthetic. That is, synthetic or partially optimized sequences may also be used.

For efficient initiation of translation, sequences adjacent to the initiating methionine may be modified. For example, they can be modified by the inclusion of sequences known to be effective in plants. Joshi has suggested an appropriate consensus for plants (*Nucleic Acids Research* 15:6643-6653 (1987)) and Clonetech suggests a further consensus translation initiator (1993/1994 catalog, page 210). These consensuses are suitable for use with the nucleotide sequences of this invention. The sequences are incorporated into constructions comprising the nucleotide sequences, up to and including the ATG (whilst leaving the second amino acid unmodified), or alternatively up to and including the GTC subsequent to the ATG (with the possibility of modifying the second amino acid of the transgene).

In addition to the selection of a suitable promoter, constructions for expression of a pesticidal polypeptide in plants can require an appropriate transcription terminator to be attached downstream of the heterologous nucleotide sequence. Several such terminators are available and known in the art (e.g. tm1 from CaMV, E9 from rbcS). Any available terminator known to function in plants can be used in the context of this invention.

Numerous other sequences can be incorporated into expression cassettes and/or nucleic acid molecules of the invention. These include sequences that have been shown to enhance expression such as intron sequences (e.g. from Adh1 and bronze1) and viral leader sequences (e.g. from TMV, MCMV and AMV).

In some embodiments, the expression of the polynucleotides of the invention can be targeted to different cellular localizations in the plant. In some embodiments, localization in the cytosol may be desirable, whereas in other embodiments, localization in some subcellular organelle may be desired. Subcellular localization of transgene-encoded enzymes is undertaken using techniques well known in the art. Typically, the DNA encoding the target peptide from a known organelle-targeted gene product is manipulated and fused upstream of the polynucleotide sequence. Many such target sequences are known for the chloroplast and their functioning in heterologous constructions has been shown. The expression of the polynucleotides of the invention also can be targeted to the endoplasmic reticulum or to the vacuoles of the host cells. Techniques for targeting nucleotide sequences to particular organelles are well known in the art.

Procedures for transforming plants are well known and routine in the art and are described throughout the literature. Non-limiting examples of methods for transformation of plants include transformation via bacterial-mediated nucleic acid delivery (e.g., via *Agrobacteria*), viral-mediated nucleic acid delivery, silicon carbide or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. General guides to various plant transformation methods known in the art include Miki et al. ("Procedures for Introducing Foreign DNA into Plants" in *Methods in Plant Molecular Biology and Biotechnology*, Glick, B. R. and Thompson, J. E., Eds. (CRC Press, Inc., Boca Raton, 1993), pages 67-88) and Rakowoczy-Trojanowska (*Cell. Mol. Biol. Lett.* 7:849-858 (2002)).

For *Agrobacterium*-mediated transformation, binary vectors or vectors carrying at least one T-DNA border sequence are suitable, whereas for direct gene transfer (e.g., particle bombardment and the like) any vector is suitable and linear DNA containing only the construction of interest can be used. In the case of direct gene transfer, transformation with a single DNA species or co-transformation can be used (Schocher et al., *Biotechnology* 4:1093-1096 (1986)). For both direct gene transfer and *Agrobacterium*-mediated transfer, transformation is usually (but not necessarily) undertaken with a selectable marker that may be a positive selection (Phosphomannose Isomerase), provide resistance to an antibiotic (kanamycin, hygromycin or methotrexate) or a herbicide (glyphosate or basta). However, the choice of selectable marker is not critical to the invention.

*Agrobacterium*-mediated transformation is a commonly used method for transforming plants, in particular, dicot plants, because of its high efficiency of transformation and because of its broad utility with many different species. *Agrobacterium*-mediated transformation typically involves transfer of the binary vector carrying the foreign DNA of interest to an appropriate *Agrobacterium* strain that may depend on the complement of vir genes carried by the host *Agrobacterium* strain either on a co-resident Ti plasmid or chromosomally (Uknes et al. (1993) *Plant Cell* 5:159-169). The transfer of the recombinant binary vector to *Agrobacterium* can be accomplished by a triparental mating procedure using *Escherichia coli* carrying the recombinant binary vector, a helper *E. coli* strain that carries a plasmid that is able to mobilize the recombinant binary vector to the target *Agrobacterium* strain. Alternatively, the recombinant binary vector can be transferred to *Agrobacterium* by nucleic acid transformation (Hofgen & Willmitzer (1988) *Nucleic Acids Res.* 16:9877).

Transformation of a plant by recombinant *Agrobacterium* usually involves co-cultivation of the *Agrobacterium* with explants from the plant and follows methods well known in the art. Transformed tissue is regenerated on selection medium carrying an antibiotic or herbicide resistance marker between the binary plasmid T-DNA borders.

As discussed previously, another method for transforming plants, plant parts and plant cells involves propelling inert or biologically active particles at plant tissues and cells. See, e.g., U.S. Pat. Nos. 4,945,050; 5,036,006 and 5,100,792. Generally, this method involves propelling inert or biologically active particles at the plant cells under conditions effective to penetrate the outer surface of the cell and afford incorporation within the interior thereof. When inert particles are utilized, the vector can be introduced into the cell by coating the particles with the vector containing the nucleic acid of interest. Alternatively, a cell or cells can be surrounded by the vector so that the vector is carried into the cell by the wake of the particle. Biologically active particles (e.g., a dried yeast cell, a dried bacterium or a bacteriophage, each containing one or more nucleic acids sought to be introduced) also can be propelled into plant tissue.

In another embodiment, a polynucleotide of the invention can be directly transformed into the plastid genome. A major advantage of plastid transformation is that plastids are generally capable of expressing bacterial genes without substantial modification, and plastids are capable of expressing multiple open reading frames under control of a single promoter. Plastid transformation technology is extensively described in U.S. Pat. Nos. 5,451,513, 5,545,817, and 5,545,818, in PCT application no. WO 95/16783, and in McBride et al. (1994) *Proc. Natl. Acad. Sci. USA* 91, 7301-7305. The basic technique for chloroplast transformation involves introducing regions of cloned plastid DNA flanking a selectable marker together with the gene of interest into a suitable target tissue, e.g., using biolistics or protoplast transformation (e.g., calcium chloride or PEG mediated transformation). The 1 to 1.5 kb flanking regions, termed targeting sequences, facilitate homologous recombination with the plastid genome and thus allow the replacement or modification of specific regions of the plastome. Initially, point mutations in the chloroplast 16S rRNA and rps12 genes conferring resistance to spectinomycin and/or streptomycin can be utilized as selectable markers for transformation (Svab, Z., Hajdukiewicz, P., and Maliga, P. (1990) *Proc. Natl. Acad. Sci. USA* 87, 8526-8530; Staub, J. M., and Maliga, P. (1992) *Plant Cell* 4, 39-45). The presence of cloning sites between these markers allows creation of a plastid targeting vector for introduction of foreign genes (Staub, J. M., and Maliga, P. (1993) *EMBO J.* 12, 601-606). Substantial increases in transformation frequency can be obtained by replacement of the recessive rRNA or r-protein antibiotic resistance genes with a dominant selectable marker, the bacterial aadA gene encoding the spectinomycin-cletoxifying enzyme aminoglycoside-3'-adenyltransferase (Svab, Z., and Maliga, P. (1993) *Proc. Natl. Acad. Sci. USA* 90, 913-917). Previously, this marker had been used successfully for high-frequency transformation of the plastid genome of the green alga *Chlamydomonas reinhardtii* (Goldschmidt-Clermont, M. (1991) *Nucl. Acids Res.* 19:4083-4089). Other selectable markers useful for plastid transformation are known in the art and encompassed within the scope of the invention. Typically, approximately 15-20 cell division cycles following transformation are required to reach a homoplastidic state. Plastid expression, in which genes are inserted by homologous recombination into all of the several thousand copies of the circular plastid genome present in each plant cell, takes advantage of the enormous copy number advantage over nuclear-expressed genes to permit expression levels that can readily exceed 10% of the total soluble plant protein. In one embodiment, a polynucleotide of the invention can be inserted into a plastid-targeting vector and transformed into the plastid genome of a desired plant host. Thus, plants homoplastic for plastid genomes containing a nucleotide sequence of the invention can be obtained, which are capable of high expression of the polynucleotide.

Methods of selecting for transformed, transgenic plants, plant cells and/or plant tissue culture are routine in the art and can be employed in the methods of the invention provided herein.

Further, as is well known in the art, intact transgenic plants can be regenerated from transformed plant cells, plant tissue culture and/or cultured protoplasts using any of a variety of known techniques. Plant regeneration from plant cells, plant tissue culture and/or cultured protoplasts is described, for example, in Evans et al. (*Handbook of Plant Cell Cultures*, Vol. 1, MacMilan Publishing Co. New York (1983)); and Vasil I. R. (ed.) (*Cell Culture and Somatic Cell Genetics of Plants*, Acad. Press, Orlando, Vol. I (1984), and Vol. II (1986)).

Additionally, the genetic properties engineered into the transgenic seeds and plants, plant parts, and/or plant cells of the invention described above can be passed on by sexual reproduction or vegetative growth and therefore can be maintained and propagated in progeny plants. Generally, maintenance and propagation make use of known agricultural methods developed to fit specific purposes such as harvesting, sowing or tilling.

A polynucleotide therefore can be introduced into the plant, plant part and/or plant cell in any number of ways that are well known in the art, as described above. Therefore, no particular method for introducing one or more polynucleotides into a plant is relied upon, rather any method that allows the one or more polynucleotides to gain access to the interior of at least one cell of the plant can be used. Where more than one polynucleotides is to be introduced, the respective polynucleotides can be assembled as part of a single nucleic acid molecule, or as separate nucleic acid molecules, and can be located on the same or different nucleic acid molecules. Accordingly, the polynucleotides can be introduced into the cell of interest in a single transformation event, in separate transformation events, or, for example, in plants, as part of a breeding protocol.

In some embodiments of this invention, the introduced nucleic acid molecule may be maintained in the plant cell stably if it is incorporated into a non-chromosomal autonomous replicon or integrated into the plant chromosome(s). Alternatively, the introduced nucleic acid molecule may be present on an extra-chromosomal non-replicating vector and be transiently expressed or transiently active. Whether present in an extra-chromosomal non-replicating vector or a vector that is integrated into a chromosome, the nucleic acid molecule can be present in a plant expression cassette. A plant expression cassette can contain regulatory sequences that drive gene expression in plant cells that are operatively linked so that each sequence can fulfill its function, for example, termination of transcription by polyadenylation signals. Exemplary polyadenylation signals can be those originating from *Agrobacterium tumefaciens* t-DNA such as the gene known as octopine synthase of the Ti-plasmid pTiACH5 (Gielen et al. *EMBO J.* 3:835 (1984)) or functional equivalents thereof, but also all other terminators functionally active in plants are suitable. A plant expression cassette of this invention can also contain other operatively linked sequences like translational enhancers such as the overdrive-sequence containing the 5'-untranslated leader sequence from tobacco mosaic virus enhancing the polypeptide per RNA ratio (Gallie et al. *Nucl. Acids Research* 15:8693-8711 (1987)).

Thus, some embodiments of the invention are directed to expression cassettes designed to express the polynucleotides and nucleic acid molecules of the invention. As used herein, "expression cassette" means a nucleic acid molecule having at least a control sequence operatively linked to a nucleotide sequence of interest. In this manner, for example, plant promoters in operable association with the nucleotide sequences to be expressed are provided in expression cassettes for expression in a plant, plant part and/or plant cell.

An expression cassette comprising a nucleotide sequence of interest may be chimeric, meaning that at least one of its components is heterologous with respect to at least one of its other components. An expression cassette may also be one that is naturally occurring but has been obtained in a recombinant form useful for heterologous expression. Typically, however, the expression cassette is heterologous with respect to the host, i.e., the particular nucleic acid sequence of the expression cassette does not occur naturally in the host cell and must have been introduced into the host cell or an ancestor of the host cell by a transformation event.

In addition to the promoters operatively linked to the nucleotide sequences of the invention, an expression cassette of this invention also can include other regulatory sequences. As used herein, "regulatory sequences" means nucleotide sequences located upstream (5' non-coding sequences), within or downstream (3' non-coding sequences) of a coding sequence, and which influence the transcription, RNA processing or stability, or translation of the associated coding sequence. Regulatory sequences include, but are not limited to, enhancers, introns, translation leader sequences, termination signals, and polyadenylation signal sequences.

A number of non-translated leader sequences derived from viruses are known to enhance gene expression. Specifically, leader sequences from Tobacco Mosaic Virus (TMV, the "ω-sequence"), Maize Chlorotic Mottle Virus (MCMV) and Alfalfa Mosaic Virus (AMV) have been shown to be effective in enhancing expression (Gallie et al. (1987) *Nucleic Acids Res.* 15:8693-8711; and Skuzeski et al. (1990) *Plant Mol. Biol.* 15:65-79). Other leader sequences known in the art include, but are not limited to, picornavirus leaders such as an encephalomyocarditis (EMCV) 5' non-coding region leader (Elroy-Stein et al. (1989) *Proc. Natl. Acad. Sci. USA* 86:6126-6130); potyvirus leaders such as a Tobacco Etch Virus (TEV) leader (Allison et al. (1986) *Virology* 154:9-20); Maize Dwarf Mosaic Virus (MDMV) leader (Allison et al. (1986), supra); human immunoglobulin heavy-chain binding protein (BiP) leader (Macejak & Samow (1991) *Nature* 353:90-94); untranslated leader from the coat protein mRNA of AMV (AMV RNA 4; Jobling & Gehrke (1987) *Nature* 325:622-625); tobacco mosaic TMV leader (Gallie et al. (1989) *Molecular Biology of RNA* 237-256); and MCMV leader (Lommel et al. (1991) *Virology* 81:382-385). See also, Della-Cioppa et al. (1987) *Plant Physiol.* 84:965-968.

An expression cassette also can optionally include a transcriptional and/or translational termination region (i.e., termination region) that is functional in plants. A variety of transcriptional terminators are available for use in expression cassettes and are responsible for the termination of transcription beyond the heterologous nucleotide sequence of interest and correct mRNA polyadenylation. The termination region may be native to the transcriptional initiation region, may be native to the operatively linked nucleotide sequence of interest, may be native to the plant host, or may be derived from another source (i.e., foreign or heterologous to the promoter, the nucleotide sequence of interest, the plant host, or any combination thereof). Appropriate transcriptional terminators include, but are not limited to, the CAMV 35S terminator, the tml terminator, the nopaline synthase terminator and the pea rbcs E9 terminator. These can be used in both monocotyledons and dicotyledons. In addition, a coding sequence's native transcription terminator can be used.

The expression cassette also can include a nucleotide sequence for a selectable marker, which can be used to select a transformed plant, plant part and/or plant cell. As used herein, "selectable marker" means a nucleotide sequence that when expressed imparts a distinct phenotype to the plant, plant part and/or plant cell expressing the marker and thus allows such transformed plants, plant parts and/or plant cells to be distinguished from those that do not have the marker. Such a nucleotide sequence may encode either a selectable or screenable marker, depending on whether the marker confers a trait that can be selected for by chemical means, such as by using a selective agent (e.g., an antibiotic, herbicide, or the like), or on whether the marker is simply a trait that one can identify through observation or testing, such as by screening (e.g., the R-locus trait). Of course, many examples of suitable selectable markers are known in the art and can be used in the expression cassettes described herein.

Examples of selectable markers include, but are not limited to, a nucleotide sequence encoding neo or nptII, which confers resistance to kanamycin, G418, and the like (Potrykus et al. (1985) *Mol. Gen. Genet.* 199:183-188); a nucleotide sequence encoding bar, which confers resistance to phosphinothricin; a nucleotide sequence encoding an altered 5-enolpyruvylshikimate-3-phosphate (EPSP) synthase, which confers resistance to glyphosate (Hinchee et al. (1988) *Biotech.* 6:915-922); a nucleotide sequence encoding a nitrilase such as bxn from *Klebsiella ozaenae* that confers resistance to bromoxynil (Stalker et al. (1988) *Science* 242:419-423); a nucleotide sequence encoding an altered acetolactate synthase (ALS) that confers resistance to imidazolinone, sulfonylurea or other ALS-inhibiting chemicals (EP Patent Application No. 154204); a nucleotide sequence encoding a methotrexate-resistant dihydrofolate reductase (DHFR) (Thillet et al. (1988) *J. Biol. Chem.* 263:12500-12508); a nucleotide sequence encoding a dalapon dehalogenase that confers resistance to dalapon; a nucleotide sequence encoding a mannose-6-phosphate isomerase (also referred to as phosphomannose isomerase (PMI)) that confers an ability to metabolize mannose (U.S. Pat. Nos. 5,767,378 and 5,994,629); a nucleotide sequence encoding an altered anthranilate synthase that confers resistance to 5-methyl tryptophan; and/or a nucleotide sequence encoding hph that confers resistance to hygromycin. One of skill in the art is capable of choosing a suitable selectable marker for use in an expression cassette of this invention.

Additional selectable markers include, but are not limited to, a nucleotide sequence encoding β-glucuronidase or uidA (GUS) that encodes an enzyme for which various chromogenic substrates are known; an R-locus nucleotide sequence that encodes a product that regulates the production of anthocyanin pigments (red color) in plant tissues (Dellaporta et al., "Molecular cloning of the maize R-nj allele by transposon-tagging with Ac" 263-282 In: *Chromosome Structure and Function: Impact of New Concepts*, 18th Stadler Genetics Symposium (Gustafson & Appels eds., Plenum Press 1988)); a nucleotide sequence encoding β-lactamase, an enzyme for which various chromogenic substrates are known (e.g., PADAC, a chromogenic cephalosporin) (Sutcliffe (1978) *Proc. Natl. Acad. Sci. USA* 75:3737-3741); a nucleotide sequence encoding xylE that encodes a catechol dioxygenase (Zukowsky et al. (1983) *Proc. Natl. Acad. Sci. USA* 80:1101-1105); a nucleotide sequence encoding tyrosinase, an enzyme capable of oxidizing tyrosine to DOPA and dopaquinone, which in turn condenses to form melanin (Katz et al. (1983) *J. Gen. Microbiol.* 129:2703-2714); a nucleotide sequence encoding β-galactosidase, an enzyme for which there are chromogenic substrates; a nucleotide sequence encoding luciferase (lux) that allows for bioluminescence detection (Ow et al. (1986) *Science* 234:856-859); a nucleotide sequence encoding aequorin which may be employed in calcium-sensitive bioluminescence detection (Prasher et al. (1985) *Biochem. Biophys. Res. Comm.* 126:1259-1268); or a nucleotide sequence encoding green fluorescent protein (Niedz et al.

(1995) *Plant Cell Reports* 14:403-406). One of skill in the art is capable of choosing a suitable selectable marker for use in an expression cassette of this invention.

In some embodiments, an expression cassette of the invention also can include nucleotide sequences that encode other desired traits. Such nucleotide sequences can be stacked with any combination of nucleotide sequences to create plants, plant parts or plant cells having the desired phenotype. Stacked combinations can be created by any method including, but not limited to, cross breeding plants by any conventional methodology, or by genetic transformation. If stacked by genetically transforming the plants, the nucleotide sequences of interest can be combined at any time and in any order. For example, a transgenic plant comprising one or more desired traits can be used as the target to introduce further traits by subsequent transformation. The additional nucleotide sequences can be introduced simultaneously in a co-transformation protocol with a nucleotide sequence, nucleic acid molecule, nucleic acid construct, and/or composition of this invention, provided by any combination of expression cassettes. For example, if two nucleotide sequences will be introduced, they can be incorporated in separate cassettes (trans) or can be incorporated on the same cassette (cis). Expression of polynucleotides can be driven by the same promoter or by different promoters. It is further recognized that polynucleotides can be stacked at a desired genomic location using a site-specific recombination system. See, e.g., Int'l Patent Application Publication Nos. WO 99/25821; WO 99/25854; WO 99/25840; WO 99/25855 and WO 99/25853.

The expression cassette also can include a coding sequence for one or more polypeptides for agronomic traits that primarily are of benefit to a seed company, grower or grain processor. A polypeptide of interest can be any polypeptide encoded by a nucleotide sequence of interest. Non-limiting examples of polypeptides of interest that are suitable for production in plants include those resulting in agronomically important traits such as herbicide resistance (also sometimes referred to as "herbicide tolerance"), virus resistance, bacterial pathogen resistance, insect resistance, nematode resistance, and/or fungal resistance. See, e.g., U.S. Pat. Nos. 5,569,823; 5,304,730; 5,495,071; 6,329,504; and 6,337,431. The polypeptide also can be one that increases plant vigor or yield (including traits that allow a plant to grow at different temperatures, soil conditions and levels of sunlight and precipitation), or one that allows identification of a plant exhibiting a trait of interest (e.g., a selectable marker, seed coat color, etc.). Various polypeptides of interest, as well as methods for introducing these polypeptides into a plant, are described, for example, in U.S. Pat. Nos. 4,761,373; 4,769,061; 4,810,648; 4,940,835; 4,975,374; 5,013,659; 5,162,602; 5,276,268; 5,304,730; 5,495,071; 5,554,798; 5,561,236; 5,569,823; 5,767,366; 5,879,903; 5,928,937; 6,084,155; 6,329,504 and 6,337,431; as well as US Patent Publication No. 2001/0016956. See also, on the World Wide Web at lifesci.sussex.ac.uk/home/Neil_Crickmore/Bt/.

Polynucleotides conferring resistance/tolerance to an herbicide that inhibits the growing point or meristem, such as an imidazalinone or a sulfonylurea can also be suitable in some embodiments of the invention. Exemplary polynucleotides in this category code for mutant ALS and AHAS enzymes as described, e.g., in U.S. Pat. Nos. 5,767,366 and 5,928,937. U.S. Pat. Nos. 4,761,373 and 5,013,659 are directed to plants resistant to various imidazalinone or sulfonamide herbicides. U.S. Pat. No. 4,975,374 relates to plant cells and plants containing a nucleic acid encoding a mutant glutamine synthetase (GS) resistant to inhibition by herbicides that are known to inhibit GS, e.g., phosphinothricin and methionine sulfoximine. U.S. Pat. No. 5,162,602 discloses plants resistant to inhibition by cyclohexanedione and aryloxyphenoxypropanoic acid herbicides. The resistance is conferred by an altered acetyl coenzyme A carboxylase (ACCase).

Polypeptides encoded by nucleotides sequences conferring resistance to glyphosate are also suitable for the invention. See, e.g., U.S. Pat. No. 4,940,835 and U.S. Pat. No. 4,769,061. U.S. Pat. No. 5,554,798 discloses transgenic glyphosate resistant maize plants, which resistance is conferred by an altered 5-enolpyruvyl-3-phosphoshikimate (EPSP) synthase gene.

Polynucleotides coding for resistance to phosphono compounds such as glufosinate ammonium or phosphinothricin, and pyridinoxy or phenoxy propionic acids and cyclohexones are also suitable. See, European Patent Application No. 0 242 246. See also, U.S. Pat. Nos. 5,879,903, 5,276,268 and 5,561,236.

Other suitable polynucleotides include those coding for resistance to herbicides that inhibit photosynthesis, such as a triazine and a benzonitrile (nitrilase) See, U.S. Pat. No. 4,810,648. Additional suitable polynucleotides coding for herbicide resistance include those coding for resistance to 2,2-dichloropropionic acid, sethoxydim, haloxyfop, imidazolinone herbicides, sulfonylurea herbicides, triazolopyrimidine herbicides, s-triazine herbicides and bromoxynil. Also suitable are polynucleotides conferring resistance to a protox enzyme, or that provide enhanced resistance to plant diseases; enhanced tolerance of adverse environmental conditions (abiotic stresses) including but not limited to drought, excessive cold, excessive heat, or excessive soil salinity or extreme acidity or alkalinity; and alterations in plant architecture or development, including changes in developmental timing. See, e.g., U.S. Patent Publication No. 2001/0016956 and U.S. Pat. No. 6,084,155.

Additional suitable polynucleotides include those coding for pesticidal (e.g., insecticidal) polypeptides. These polypeptides may be produced in amounts sufficient to control, for example, insect pests (i.e., insect controlling amounts). It is recognized that the amount of production of pesticidal polypeptide in a plant necessary to control insects or other pests may vary depending upon the cultivar, type of pest, environmental factors and the like. Polynucleotides useful for additional insect or pest resistance include, for example, those that encode toxins identified in *Bacillus* organisms. Polynucleotides encoding *Bacillus thuringiensis* (Bt) toxins from several subspecies *have* been cloned and recombinant clones have been found to be toxic to lepidopteran, dipteran and coleopteran insect larvae (for example, various delta-endotoxin genes such as Cry1Aa, Cry1Ab, Cry1Ac, Cry1B, Cry1C, Cry1D, Cry1Ea, Cry1Fa, Cry3A, Cry9A, Cry9C and Cry9B; as well as genes encoding vegetative insecticidal proteins such as Vip1, Vip2 and Vip3). A full list of Bt toxins can be found on the worldwide web at *Bacillus thuringiensis* Toxin Nomenclature Database maintained by the University of Sussex (see also, Crickmore et al. (1998) *Microbiol. Mol. Biol. Rev.* 62:807-813).

Polypeptides that are suitable for production in plants further include those that improve or otherwise facilitate the conversion of harvested plants and/or plant parts into a commercially useful product, including, for example, increased or altered carbohydrate content and/or distribution, improved fermentation properties, increased oil content, increased protein content, improved digestibility, and increased nutraceutical content, e.g., increased phytosterol content, increased tocopherol content, increased stanol content and/or increased vitamin content. Polypeptides of interest also include, for example, those resulting in or contributing to a reduced content of an unwanted component in a harvested crop, e.g., phytic acid, or sugar degrading enzymes. By "resulting in" or "contributing to" is intended that the polypeptide of interest can directly or indirectly contribute to the existence of a trait of interest (e.g., increasing cellulose degradation by the use of a heterologous cellulase enzyme).

In one embodiment, the polypeptide contributes to improved digestibility for food or feed. Xylanases are hemicellulolytic enzymes that improve the breakdown of plant cell walls, which leads to better utilization of the plant nutrients by an animal. This leads to improved growth rate and feed conversion. Also, the viscosity of the feeds containing xylan can be reduced. Heterologous production of xylanases in plant cells also can facilitate lignocellulosic conversion to fermentable sugars in industrial processing.

Numerous xylanases from fungal and bacterial microorganisms have been identified and characterized (see, e.g., U.S. Pat. No. 5,437,992; Coughlin et al. (1993) "Proceedings of the Second TRICEL Symposium on *Trichoderma reesei* Cellulases and Other Hydrolases" Espoo; Souminen and Reinikainen, eds. (1993) *Foundation for Biotechnical and Industrial Fermentation Research* 8:125-135; U.S. Patent Publication No. 2005/0208178; and PCT Publication No. WO 03/16654). In particular, three specific xylanases (XYL-I, XYL-II, and XYL-III) have been identified in *T. reesei* (Tenkanen et al. (1992) *Enzyme Microb. Technol.* 14:566; Torronen et al. (1992) *Bio/Technology* 10:1461; and Xu et al. (1998) *Appl. Microbiol. Biotechnol.* 49:718).

In another embodiment, a polypeptide useful for the invention can be a polysaccharide degrading enzyme. Plants of this invention producing such an enzyme may be useful for generating, for example, fermentation feedstocks for bioprocessing. In some embodiments, enzymes useful for a fermentation process include alpha amylases, proteases, pullulanases, isoamylases, cellulases, hemicellulases, xylanases, cyclodextrin glycotransferases, lipases, phytases, laccases, oxidases, esterases, cutinases, granular starch hydrolyzing enzyme and other glucoamylases.

Polysaccharide-degrading enzymes include: starch degrading enzymes such as α-amylases (EC 3.2.1.1), glucuronidases (E.C. 3.2.1.131); exo-1,4-α-D glucanases such as amyloglucosidases and glucoamylase (EC 3.2.1.3), β-amylases (EC 3.2.1.2), α-glucosidases (EC 3.2.1.20), and other exo-amylases; starch debranching enzymes, such as a) isoamylase (EC 3.2.1.68), pullulanase (EC 3.2.1.41), and the like; b) cellulases such as exo-1,4-3-cellobiohydrolase (EC 3.2.1.91), exo-1,3-β-D-glucanase (EC 3.2.1.39), β-glucosidase (EC 3.2.1.21); c) L-arabinases, such as endo-1,5-α-L-arabinase (EC 3.2.1.99), α-arabinosidases (EC 3.2.1.55) and the like; d) galactanases such as endo-1,4-β-D-galactanase (EC 3.2.1.89), endo-1,3-β-D-galactanase (EC 3.2.1.90), α-galactosidase (EC 3.2.1.22), β-galactosidase (EC 3.2.1.23) and the like; e) mannanases, such as endo-1,4-β-D-mannanase (EC 3.2.1.78), β-mannosidase (EC 3.2.1.25), α-mannosidase (EC 3.2.1.24) and the like; f) xylanases, such as endo-1,4-β-xylanase (EC 3.2.1.8), β-D-xylosidase (EC 3.2.1.37), 1,3-β-D-xylanase, and the like; and g) other enzymes such as α-L-fucosidase (EC 3.2.1.51), α-L-rhamnosidase (EC 3.2.1.40), levanase (EC 3.2.1.65), inulanase (EC 3.2.1.7), and the like.

Further enzymes which may be used with the invention include proteases, such as fungal and bacterial proteases. Fungal proteases include, but are not limited to, those obtained from *Aspergillus*, *Trichoderma*, *Mucor* and *Rhizopus*, such as *A. niger*, *A. awamori*, *A. oryzae* and *M. miehei*. In some embodiments, the polypeptides of this invention can be cellobiohydrolase (CBH) enzymes (EC 3.2.1.91). In one embodiment, the cellobiohydrolase enzyme can be CBH1 or CBH2.

Other enzymes useful with the invention include, but are not limited to, hemicellulases, such as mannases and arabinofuranosidases (EC 3.2.1.55); ligninases; lipases (e.g., E.C. 3.1.1.3), glucose oxidases, pectinases, xylanases, transglucosidases, alpha 1,6 glucosidases (e.g., E.C. 3.2.1.20); esterases such as ferulic acid esterase (EC 3.1.1.73) and acetyl xylan esterases (EC 3.1.1.72); and cutinases (e.g. E.C. 3.1.1.74).

As used herein, "plant" means any plant and thus includes, for example, angiosperms including both monocots and dicots, gymnosperms, bryophytes, ferns and/or fern allies. In some embodiments of this invention, the plant is a seed plant. Further, a "plant" of this invention is any plant at any stage of development.

As used herein, the term "plant part" or "plant material" includes but is not limited to embryos, pollen, ovules, seeds, leaves, stems, roots, flowers or flower parts, branches, fruit, kernels, ears, cobs, husks, stalks, roots, root tips, anthers, pollen, egg cells, zygotes, cuttings, plant cells including plant cells that are intact in plants and/or parts of plants, plant protoplasts, plant tissues, plant cell tissue cultures, plant calli, plant clumps, or any other part or product of a plant. Further, as used herein, "plant cell" refers to a structural and physiological unit of the plant comprising a protoplast and a cell wall. Thus, in some embodiments, a plant cell of the invention can be in the form of an isolated single cell or can be a cultured cell or can be a part of a higher-organized unit such as, for example, a plant tissue or a plant organ.

A "protoplast" is an isolated plant cell without a cell wall or with only parts of the cell wall.

"Plant cell culture" means cultures of plant units such as, for example, protoplasts, cell culture cells, cells in plant tissues, pollen, pollen tubes, ovules, embryo sacs, zygotes and embryos at various stages of development.

As used herein, a "plant organ" is a distinct and visibly structured and differentiated part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural and/or functional units. The use of this term in conjunction with, or in the absence of, any specific type of plant tissue as listed above or otherwise embraced by this definition is not intended to be exclusive of any other type of plant tissue.

Non-limiting examples of plants can include vegetable crops, including artichokes, kohlrabi, arugula, leeks, asparagus, lettuce (e.g., head, leaf, romaine), bok choy, malanga, melons (e.g., muskmelon, watermelon, crenshaw, honeydew, cantaloupe), cole crops (e.g., brussels sprouts, cabbage, cauliflower, broccoli, collards, kale, chinese cabbage, bok choy) cardoni, carrots, napa, okra, onions, celery, parsley, chick peas, parsnips, chicory, peppers, potatoes, cucurbits (e.g., marrow, cucumber, zucchini, squash, pumpkin), radishes, dry bulb onions, rutabaga, eggplant (also called brinjal), salsify, escarole, shallots, endive, garlic, spinach, green onions, squash, greens, beet (sugar beet and fodder beet), sweet potatoes, swiss chard, horseradish, tomatoes, turnips, and spices; a fruit and/or vine crop such as apples, apricots, cherries, nectarines, peaches, pears, plums, prunes, cherry, quince, almonds, chestnuts, filberts, pecans, pistachios, walnuts, citrus, blueberries, boysenberries, cranberries, currants, loganberries, raspberries, strawberries, blackberries, grapes, avocados, bananas, kiwi, persimmons, pomegranate, pineapple, tropical fruits, pomes, melon, mango, papaya, and lychee; a field crop plant such as clover, alfalfa, evening primrose, meadow foam, corn/maize (field, sweet, popcorn), hops, jojoba, peanuts, rice, safflower, small grains (barley, oats, rye, wheat, etc.), sorghum, tobacco, kapok, a leguminous plant (beans, lentils, peas, soybeans), an oil plant (rape, mustard, poppy, olive, sunflower, coconut, castor oil plant, cocoa bean, groundnut), *Arabidopsis*, a fibre plant (cotton, flax, hemp, jute), lauraceae (cinnamon, camphor), or a plant such as coffee, sugar cane, tea, and natural rubber plants; and/or a bedding plant such as a flowering plant, a cactus, a succulent and/or an ornamental plant, as well as trees such as forest (broad-leaved trees and evergreens, such as conifers), fruit, ornamental, and nut-bearing trees, as well as shrubs and other nursery stock.

In some particular embodiments, the plant of this invention can be sorghum, wheat, sunflower, tomato, cole crops, cotton, rice, soybean, sugar beet, sugar cane, tobacco, barley, oilseed rape and maize. In other embodiments, the plant is maize.

Once a desired polynucleotide has been transformed into a particular plant species, it may be propagated in that species or moved into other varieties of the same species, particularly including commercial varieties, using traditional breeding techniques.

Additional aspects of the invention include harvested products produced from the transgenic plants and/or parts thereof of the invention, as well as a processed product produced from said harvested products. A harvested product can be a whole plant or any plant part, as described herein. Thus, in some embodiments, non-limiting examples of a harvested product include a seed, a fruit, a flower or part thereof (e.g., an anther, a stigma, and the like), a leaf, a stem, and the like. In other embodiments, a processed product includes, but is not limited to, a flour, meal, oil, starch, cereal, and the like produced from a harvested seed of the invention, wherein said seed comprises a nucleic acid molecule/polynucleotide/nucleotide sequence of this invention.

In other embodiments, the invention provides an extract from a transgenic seed and/or a transgenic plant of the invention, wherein the extract comprises a nucleic acid molecule, a polynucleotide, a nucleotide sequence or a polypeptide of the invention. Extracts from plants or plant parts can be made according to procedures well known in the art (See, de la Torre et al., *Food, Agric. Environ.* 2(1):84-89 (2004); Guidet, *Nucleic Acids Res.* 22(9): 1772-1773 (1994); Lipton et al., *Food Agric. Immun.* 12:153-164 (2000)).

A still further aspect of the invention is a composition comprising an engineered polypeptide of the invention in an agriculturally acceptable carrier.

As used herein an "agriculturally-acceptable carrier" can include natural or synthetic, organic or inorganic material which is combined with the active component to facilitate its application to the plant, or part thereof. An agriculturally-acceptable carrier includes, but is not limited to, inert components, dispersants, surfactants, adjuvants, tackifiers, stickers, binders, or combinations thereof, that can be used in agricultural formulations. Another agriculturally acceptable carrier may be a transgenic plant or plant part.

Such compositions can be applied in any manner that brings the pesticidal polypeptides in contact with the pests. Accordingly, the compositions can be applied to the surfaces of plants or plant parts, including seeds, leaves, flowers, stems, tubers, roots, and the like.

In additional embodiments, a method of producing a polypeptide having pesticidal (e.g., insecticidal) activity against at least European corn borer is provided, the method comprising: expressing a polynucleotide and/or a nucleic acid molecule of the invention in a transgenic non-human host cell, thereby producing a polypeptide that has pesticidal (e.g., insecticidal) activity against at least European corn borer. In some embodiments, the transgenic non-human host cell is a plant cell. In other embodiments, the transgenic non-human host cell is a bacterial cell. In still other embodiments, the transgenic non-human host cell is a yeast cell.

In some embodiments, the polypeptide of the invention has pesticidal activity against at least one additional insect (in addition to European corn borer), wherein said additional insect includes, but is not limited to, *Plutella xylostella* (diamondback moth), *Spodoptera frugiperda* (fall armyworm), *Agrotis ipsilon* (black cutworm), *Agrotis orthogonia* (pale western cutworm), *Striacosta albicosta* (western bean cutworm), *Helicoverpa zea* (corn earworm), *Heliothis virescens* (tobacco budworm), *Spodoptera exigua* (beet armyworm), *Helicoverpa punctigera* (native budworm), *Helicoverpa armigera* (cotton bollworm), *Manduca sexta* (tobacco hornworm), *Trichoplusia ni* (cabbage looper), *Pectinophora gossypiella* (pink bollworm), *Diatraea grandiosella* (southwestern corn borer), *Diatraea saccharalis* (sugarcane borer), *Elasmopalpus lignosellus* (lesser cornstalk borer), *Psuedoplusia includens* (soybean looper), *Anticarsia gemmatalis* (velvetbean caterpillar), *Plathypena scabra* (green cloverworm), and *Cochylis hospes* (banded sunflower moth), and any combination thereof.

In a further aspect, the invention provides a method of producing a pest-resistant (e.g., an insect-resistant) transgenic plant, comprising: introducing into a plant a recombinant nucleic acid molecule comprising a nucleotide sequence encoding a polypeptide of the invention, wherein the nucleotide sequence is expressed in the plant, thereby conferring to the plant resistance to at least European corn borer, and producing a pest-resistant (e.g., an insect-resistant) transgenic plant. In some embodiments, the recombinant nucleic acid molecule is operatively linked to a heterologous promoter sequence. In some embodiments, a pest-resistant transgenic plant is resistant to at least European corn borer as compared to a control plant lacking said recombinant nucleic acid molecule.

In some aspects of the invention, a transgenic plant comprising a nucleotide sequence or nucleic acid molecule of the invention is resistant to a pest as compared to the resistance to the same pest in a control plant that does not comprise the introduced nucleic acid molecule(s) or nucleotide sequence(s) of the invention. In other aspects of the invention, a transgenic plant comprising a nucleotide sequence or nucleic acid molecule of the invention is resistant to a pest (e.g., an insect pest and/or a nematode pest) as compared to the resistance to the same pest in a control plant that does not comprise the introduced nucleic acid molecule(s) or nucleotide sequence(s) of the invention.

In some embodiments, a transgenic plant of the invention that is resistant to at least European corn borer is further resistant to at least one additional insect, wherein said additional insect includes, but is not limited to, *Ostrinia nubilalis* (European corn borer), *Plutella xylostella* (diamondback moth), *Spodoptera frugiperda* (fall armyworm), *Agrotis ipsilon* (black cutworm), *Agrotis orthogonia* (pale western cutworm), *Striacosta albicosta* (western bean cutworm), *Helicoverpa zea* (corn earworm), *Heliothis virescens* (tobacco budworm), *Spodoptera exigua* (beet armyworm), *Helicoverpa punctigera* (native budworm), *Helicoverpa armigera* (cotton bollworm), *Manduca sexta* (tobacco hornworm), *Trichoplusia ni* (cabbage looper), *Pectinophora gossypiella* (pink bollworm), *Diatraea grandiosella* (southwestern corn borer), *Diatraea saccharalis* (sugarcane borer), *Elasmopalpus lignosellus* (lesser cornstalk borer), *Psuedoplusia includens* (soybean looper), *Anticarsia gemmatalis* (velvetbean caterpillar), *Plathypena scabra* (green cloverworm), and *Cochylis hospes* (banded sunflower moth), or any combination thereof.

In further embodiments, a method of controlling at least European corn borer insects is provided, the method comprising delivering to the insects an effective amount of the engineered polypeptide of the invention.

To "deliver" a Vip polypeptide means that the polypeptide comes in contact with an insect or insect pest, resulting in toxic effect and control of the insect. To be effective, the Vip polypeptide is first orally ingested by the insect. However, the Vip polypeptide can be delivered to the insect in many recognized ways. The ways to deliver a polypeptide orally to an insect include, but are not limited to, providing the polypeptide (1) in a transgenic plant, wherein the insect eats (ingests) one or more parts of the transgenic plant, thereby ingesting the polypeptide that is expressed in the transgenic plant; (2) in a formulated protein composition(s) that can be applied to or incorporated into, for example, insect growth media; (3) in a protein composition(s) that can be applied to the surface, for example, sprayed, onto the surface of a plant part, which is then ingested by the insect as the insect eats one or more of the sprayed plant parts; (4) a bait matrix; (5) via injection into the insect; or (6) any other art-recognized toxin delivery system. Thus, any method of oral delivery to an insect can be used to deliver the pesticidal polypeptides of the invention. In some particular embodiments, the polypeptide of the invention is delivered orally to an insect, wherein the insect ingests one or more parts of a transgenic plant.

In other embodiments, the engineered polypeptide of the invention is delivered orally to an insect, wherein the insect ingests one or more parts of a plant sprayed with a composition comprising the polypeptides of the invention. Delivering the compositions of the invention to a plant surface can be done using any method known to those of skill in the art for applying compounds, compositions, formulations and the like to plant surfaces. Some non-limiting examples of delivering to or contacting a plant or part thereof include spraying, dusting, sprinkling, scattering, misting, atomizing, broadcasting, soaking, soil injection, soil incorporation, drenching (e.g., root, soil treatment), dipping, pouring, coating, leaf or stem infiltration, side dressing or seed treatment, and the like, and combinations thereof. These and other procedures for contacting a plant or part thereof with compound(s), composition(s) or formulation(s) are well-known to those of skill in the art.

In some embodiments of the invention, a method of producing a pesticidal polypeptide having improved pesticidal activity against a target cell and/or organism is provided, the method comprising: a) aligning a plurality (e.g., 2, 3, 4, 5, 6, 7, 8, 9, 10, 11, 12, 13, 14, or more) of amino acid sequences of polypeptides having at least 80% identity to one another, wherein at least one of the polypeptides exhibits at least moderate toxicity and at least another of the polypeptides exhibits no or low toxicity toward the target cell and/or organism; b) identifying at least one amino acid residue that differs between at least two of the aligned amino acid sequences of (a); c) substituting an amino acid residue for at least one amino acid residue identified in step (b) to produce a modified amino acid sequence of a modified polypeptide; d) determining the level of pesticidal activity of the modified polypeptide produced at step (c) against the target cell and/or organism; and e) selecting a modified polypeptide of (d) having improved pesticidal activity against the target cell and/or organism as compared to a polypeptide that has not been modified with the same amino acid substitution(s), thereby producing a polypeptide having improved pesticidal activity against the target cell and/or organism.

In additional embodiments of the invention, a method of producing a Vip polypeptide having improved pesticidal activity against a target cell and/or organism (e.g. an insect cell or insect) is provided, the method comprising: a) aligning a plurality (e.g., 2, 3, 4, 5, 6, 7, 8, 9, 10, 11, 12, 13, 14, or more) of amino acid sequences of Vip polypeptides having at least 80% identity to one another, wherein at least one of the Vip polypeptides exhibits at least moderate toxicity and at least another of the Vip polypeptides exhibits no or low toxicity toward the target cell and/or organism; b) identifying at least one amino acid residue that differs between at least two of the aligned Vip amino acid sequences of (a); c) substituting an amino acid residue for at least one amino acid residue identified in step (b) to produce a modified Vip3amino acid sequence of a modified Vip polypeptide; d) determining the level of pesticidal activity of the modified Vip polypeptide produced at step (c) against the target cell and/or organism; and e) selecting a modified Vip polypeptide of (d) having improved pesticidal activity against the target cell and/or organism as compared to a Vip polypeptide that has not been modified with the same amino acid substitution(s), thereby producing a Vip polypeptide having improved pesticidal activity against the target cell and/or organism. In some embodiments, the Vip polypeptide is a Vip3 polypeptide. As noted above, a Vip3 polypeptide can be identified as being a *Bacillus* polypeptide having a size of about 80-88 kDa with a highly conserved N-terminal secretion signal that is not processed (i.e., cleaved) during secretion in *Bacillus* and which comprises the amino acid sequence of IYGFATGIKDI (SEQ ID NO:114).

In some embodiments of the invention, identifying at least one amino acid residue that differs between at least two of the aligned amino acid sequences (e.g., Vip amino acid sequences) of (a) comprises identifying an essential amino acid position, a synergist amino acid position, a cryptic synergist amino acid position, or any combination thereof, in the aligned amino acid sequences of step (a) (e.g. in the aligned Vip or Vip3 amino acid sequences).

In additional aspects, the aligned amino acid sequences (e.g., a Vip or Vip3 amino acid sequence) can have at least about 80% identity (e.g., at least about 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% and/or any range therein, and/or any combination thereof) to one another. In some embodiments, at least one of the aligned amino acid sequences has no or very low toxicity toward the target organism.

"Moderate toxicity," "moderate pesticidal activity" or "moderate insecticidal activity" as used herein refers to a level of toxicity at which a target organism (e.g., insect) is susceptible (e.g., killed or growth reduced by about 50%) at a standard testing polypeptide concentration (e.g., 3 µg/cm$^3$). "No or very low activity" as used herein means that the polypeptide has no negative impact on the target organism (e.g. insect) or that the polypeptide produces less than 50% growth inhibition at a standard polypeptide concentration.

As used herein, "cryptic synergists" or "cryptic synergist positions" refers to a group of residues within a amino acid sequence of a pesticidal (e.g., insecticidal) polypeptide. These are amino acid positions wherein one or more polypeptides with at least moderate pesticidal (e.g., insecticidal) activity possess different residues and wherein one or more polypeptides with no or very low pesticidal (e.g., insecticidal) activity possess an identical residue at the same position to one of the one or more polypeptides with at least moderate pesticidal activity. By way of example and not limitation, N312 of Vip3C is a cryptic synergist position. Vip3B has an aspartic acid at position 312, but Vip3A has an asparagines (D) at this position. In formulaic terms, C=A≠B. By way of example and not limitation, K661 of Vip3C is also a cryptic synergist position. Instead of a lysine, Vip3B and Vip3A possess an asparagine at this position. In formulaic terms, B=A≠C.

"Essentials" or "essential positions" refers to a group of residues within an amino acid sequence of a pesticidal (e.g., insecticidal) polypeptide. These are amino acid positions wherein one or more polypeptides with at least moderate pesticidal (e.g., insecticidal) activity possess identical residues and wherein one or more polypeptides with no or very low pesticidal (e.g., insecticidal) activity possess a different residue at the same position. By way of example and not limitation, A257 of Vip3C is an essential position. Vip3B also has an alanine at position 257, but Vip3A has a threonine at this position. In formulaic terms, B=C≠A.

As used herein, "synergists" or "synergist positions" refers to a group of residues within a amino acid sequence of a pesticidal (e.g., insecticidal) polypeptide. These are amino acid positions wherein one or more polypeptides with at least moderate pesticidal (e.g., insecticidal) activity do not possess identical residues at the same position as compared to each other and as compared to one or more polypeptides with no or very low pesticidal (e.g., insecticidal) activity against the tested organisms. By way of example and not limitation, E760 of Vip3C is a synergist position. Vip3A has a lysine at position 760, whereas Vip3B has an alanine at this position. In formulaic terms, B≠C≠A.

The ability to target and control one or more organisms while not affecting non-target organisms can be desirable. Therefore, in some embodiments, the invention further provides a method reducing the pesticidal activity of a Vip polypeptide toward a particular target cell or organism. Thus, some aspects of the invention provide a method of producing a Vip polypeptide having reduced pesticidal activity against a target cell and/or organism, the method comprising: a) aligning a plurality (e.g., 2, 3, 4, 5, 6, 7, 8, 9, 10, 11, 12, 13, 14, or more) of amino acid sequences of Vip polypeptides, wherein at least one of the Vip polypeptides exhibits at least moderate toxicity toward the target cell and/or organism; b) identifying at least one amino acid residue that differs between at least two of the aligned Vip amino acid sequences of (a); c) substituting an amino acid residue for at least one amino acid residue identified in step (b) to produce a modified amino acid sequence of the modified Vip polypeptide; d) determining the level of pesticidal activity of the modified Vip polypeptide produced at step (c) against the target cell and/or organism; and e) selecting a modified Vip polypeptide of (d) having reduced pesticidal activity against the target cell and/or organism as compared to a Vip polypeptide that has not been modified with the same amino acid substitution, thereby producing a Vip polypeptide having reduced pesticidal activity against the target cell and/or organism.

In some embodiments of this invention, the Vip polypeptide is a Vip3 polypeptide. In additional embodiments, the Vip3 polypeptide comprises at least one amino acid mutation at a position that corresponds to a position selected from Table 1, or any combination thereof. In other embodiments, the Vip3 polypeptide comprises at least one amino acid mutation at a position corresponding to a position of V338, K455, R465, S532, I544, G580, S712, E760, L766, V768, or any combination thereof. In further embodiments, the Vip polypeptide having improved insecticidal activity has an amino acid sequence of SEQ ID NO:3, the amino acid sequence of SEQ ID NO:5, the amino acid sequence of SEQ ID NO:7, the amino acid sequence of SEQ ID NO:9, the amino acid sequence of SEQ ID NO:11, the amino acid sequence of SEQ ID NO:13, the amino acid sequence of SEQ ID NO:18, the amino acid sequence of SEQ ID NO:20, the amino acid sequence of SEQ ID NO:22, the amino acid sequence of SEQ ID NO:24, the amino acid sequence of SEQ ID NO:26, the amino acid sequence of SEQ ID NO:28, the amino acid sequence of SEQ ID NO:30, the amino acid sequence of SEQ ID NO:32, the amino acid sequence of SEQ ID NO:34, the amino acid sequence of SEQ ID NO:36, the amino acid sequence of SEQ ID NO:38, the amino acid sequence of SEQ ID NO:40, the amino acid sequence of SEQ ID NO:42, the amino acid sequence of SEQ ID NO:44, the amino acid sequence of SEQ ID NO:46, the amino acid sequence of SEQ ID NO:48, the amino acid sequence of SEQ ID NO:50, the amino acid sequence of SEQ ID NO:52, the amino acid sequence of SEQ ID NO:54, the amino acid sequence of SEQ ID NO:56, the amino acid sequence of SEQ ID NO:58, the amino acid sequence of SEQ ID NO:60, the amino acid sequence of SEQ ID NO:62, the amino acid sequence of SEQ ID NO:64, the amino acid sequence of SEQ ID NO:66, the amino acid sequence of SEQ ID NO:68, the amino acid sequence of SEQ ID NO:70, the amino acid sequence of SEQ ID NO:72, the amino acid sequence of SEQ ID NO:74, the amino acid sequence of SEQ ID NO:76, the amino acid sequence of SEQ ID NO:78, the amino acid sequence of SEQ ID NO:80, the amino acid sequence of SEQ ID NO:82, the amino acid sequence of SEQ ID NO:84, the amino acid sequence of SEQ ID NO:86, the amino acid sequence of SEQ ID NO:88, the amino acid sequence of SEQ ID NO:90, the amino acid sequence of SEQ ID NO:92, the amino acid sequence of SEQ ID NO:94, the amino acid sequence of SEQ ID NO:96, the amino acid sequence of SEQ ID NO:98, the amino acid sequence of SEQ ID NO:100, the amino acid sequence of SEQ ID NO:102, the amino acid sequence of SEQ ID NO:104, the amino acid sequence of SEQ ID NO:106, the amino acid sequence of SEQ ID NO:108, the amino acid sequence of SEQ ID NO:110, the amino acid sequence of SEQ ID NO:112, or any combination thereof.

As one of skill in the art would appreciate, the methods of the invention can also be used to reduce the pesticidal activity of other polypeptides toward a particular target cell or organism.

A target cell or organism as used herein can be any organism or cell. In some embodiments, the target cell and/or organism is an insect or a nematode, or a cell of an insect or a nematode.

As used herein, a target insect (or insect cell) includes, but is not limited to insects from the orders *Coleoptera*, *Diptera*, *Hymenoptera*, *Lepidoptera*, *Mallophaga*, *Homoptera*, *Hemiptera*, *Orthoptera*, *Thysanoptera*, *Dermaptera*, *Isoptera*, *Anoplura*, *Siphonaptera*, or *Trichoptera*. In some embodiments, the target cell and/or organism is a target insect cell or insect from the order Lepidoptera. In other embodiments, the insect is *Ostrinia nubilalis* (European corn borer), *Plutella xylostella* (diamondback moth), *Spodoptera frugiperda* (fall armyworm), *Agrotis ipsilon* (black cutworm), *Agrotis orthogonia* (pale western cutworm), *Striacosta albicosta* (western bean cutworm), *Helicoverpa zea* (corn earworm), *Heliothis virescens* (tobacco budworm), *Spodoptera exigua* (beet armyworm), *Helicoverpa punctigera* (native budworm), *Helicoverpa armigera* (cotton bollworm), *Manduca sexta* (tobacco hornworm), *Trichoplusia ni* (cabbage looper), *Pectinophora gossypiella* (pink bollworm), *Diatraea grandiosella* (southwestern corn borer), *Diatraea saccharalis* (sugarcane borer), *Elasmopalpus lignosellus* (lesser cornstalk borer), *Psuedoplusia includens* (soybean looper), *Anticarsia gemmatalis* (velvetbean caterpillar), *Plathypena scabra* (green cloverworm), and *Cochylis hospes* (banded sunflower moth), or any combination thereof. In some particular embodiments, the lepidopteran insect is *Ostrinia nubilalis* (European corn borer).

As used herein, a target nematode (or nematode cell) includes, but is not limited to *Criconemella, Ditylenchus, Globodera, Helicotylenchus, Heterodera, Longidorus, Meloidogyne, Paratrichodorus, Pratylenchus, Radolpholus, Rotelynchus, Rotylenchulus, Tylenchulus, Xiphinema* and/or any combination thereof. In particular embodiments, a target nematode includes without limitation, *Meloidogyne* spp. (for example, *Meloidogyne incoginita* and *Meloidogyne javanica, Meloidogyne hapla, Meloidogyne arenari*), *Heterodera* spp. (for example, *Heterodera glycines, Heterodera carotae, Heterodera schachtii, Hetrodora avenae* and *Heterodora trifolii*), *Globodera* spp. (for example, *Globodera rostochiensis*), *Radopholus* spp. (for example, *Radopholus similes*), *Rotylenchulus* spp., *Pratylenchus* spp. (for example, *Pratylenchus neglectans* and *Pratylenchus penetrans*), *Aphelenchoides* spp., *Helicotylenchus* spp., *Hoplolaimus* spp., *Paratrichodorus* spp., *Longidorus* spp., *Nacobbus* spp., *Subanguina* spp. *Belonlaimus* spp., *Criconemella* spp., *Criconemoides* spp. *Ditylenchus* spp., *Ditylenchus dipsaci, Dolichodorus* spp., *Hemicriconemoides* spp., *Hemicycliophora* spp., *Hirschmaniella* spp., *Hypsoperine* spp., *Macroposthonia* spp., *Melinius* spp., *Punctodera* spp., *Quinisulcius* spp., *Scutellonema* spp., *Xiphinema* spp., *Tylenchorhynchus* spp. and/or any combination thereof.

Accordingly, as one of skill in the art would recognize, in addition to improving the pesticidal activity of Vip 3 polypeptides, the methods described herein can be used to improve pesticidal polypeptides generally, including but not limited to Vip1 polypeptides, Vip2 polypeptides and/or Cry proteins. In particular, the method of the invention can be used for identifying target amino acid positions for mutation analysis in any polypeptide where 1) one or more family members has at least moderate toxicity to a target pest; and 2) one or more members of the same family have no to very low activity against the same target pest. For example, such methods can be applied to increase the spectrum of insecticidal activity or to increase specific activity against a certain target pest.

Combinations of Insect Control Principles

The engineered pesticidal polypeptides of the invention can be used in combination with *Bacillus thuringiensis* (Bt) Cry proteins or other pesticidal principles to increase pest target range or to prevent or mitigate the development of pest resistance. A full list of Bt Cry proteins that may be useful in combinations with the engineered pesticidal polypeptides of the invention can be found on the worldwide web at *Bacillus thuringiensis* Toxin Nomenclature Database maintained by the University of Sussex (see also, Crickmore et al. (1998) *Microbiol. Mol. Biol. Rev.* 62:807-813). Other insecticidal principles include protease inhibitors (both serine and cysteine types), lectins, α-amylase, peroxidase and cholesterol oxidase. Other Vip coding sequences, such as vip1A(a) and vip2A(a) as disclosed in U.S. Pat. No. 5,849,870 and herein incorporated by reference, and other Vip3 proteins are also useful with the invention.

The co-expression of more than one insecticidal principle in the same transgenic plant can be achieved by genetically engineering a plant to contain and express all of the genes necessary as a molecular stack. Alternatively, a plant, Parent 1, can be genetically engineered for the expression of a polynucleotide encoding the engineered pesticidal polypeptides of the invention. A second plant, Parent 2, can be genetically engineered for the expression of a supplemental insect control principle. By crossing Parent 1 with Parent 2 to create a breeding stack, progeny plants can be obtained, which express all the genes introduced into Parents 1 and 2.

Transgenic plants or transgenic seed of the invention can also be treated with a chemical pesticide. Such chemical treatments may include insecticides, fungicides or nematicides. The transgenic plants or seed of the invention can be treated with an insecticide or insecticidal seed coating as described in U.S. Pat. Nos. 5,849,320 and 5,876,739, herein incorporated by reference. Where both the insecticide or insecticidal seed coating and the transgenic plant or seed of the invention are active against the same target insect, the combination is useful (i) in a method for enhancing activity of an engineered pesticidal polypeptide of the invention against the target pest and (ii) in a method for preventing development of resistance to an engineered pesticidal polypeptide of the invention by providing a second mechanism of action against the target pest. Thus, the invention provides a method of enhancing activity against or preventing development of resistance in a target pest, for example an insect pest, comprising applying an insecticide or an insecticidal seed coating to a transgenic plant or seed comprising one or more engineered pesticidal polypeptides of the invention. Examples of such insecticides include, without limitation, a synthetic pyrthroid such as tefluthrin, lambda cyhalothrin, bifenthrin, permethrin and cyfluthrin; a pyrethroid such as pyrethrin, taufluvalinate, flumethrin, trans-cyfluthrin, kadethrin, bioresmethrin, tetramethrin, phenothrin, empenthrin, cyphenothrin, prallethrin, imiprothrin, allethrin and bioallethrin; oxadiazine derivative, a chloronicotinyl, such as imidacloprid, acetamiprid, and nitenpyram; a nitroguanidine; a pyrrol, such as chlorfenapyr; a pyrazole, such as tebufenpyrad; a diacylhydrazine, such as tebufenozide, methoxyfenozide, and halofenozide; a triazole, such as triazamate; a biological/fermentation product, such as avermectin and spinosad; a phenyl pyrazole, such as fipronil; an organophosphate, such as acephate, fenamiphos, diazinon, chlorpyrifos, chlorpyrifon-methyl and malathion; and a carbamate, such as carbaryl, aldicarb, carbofuran, thiodicarb and oxamyl. Further information about pesticides of the types listed above can be found in The Pesticide Manual, 11th Ed., C. D. S. Tomlin, Ed., British Crop Protection Council, Farnham, Surry, UK (1997). Even where the insecticide or insecticidal seed coating is active against a different insect pest, the insecticide or insecticidal seed coating is useful to expand the range of insect pest control.

The invention further encompasses a method of protecting a transgenic plant of the invention against feeding damage by one or more pests, the method comprising providing a seed for the transgenic plant, wherein the seed comprises a nucleic acid molecule of the invention, and treating the seed with an effective amount of a pesticide which, in combination with the polypeptide, is effective to protect a plant which grows from the seed against feeding damage by at least one or more pests.

In another embodiment of the invention, a method of enhancing protection of a transgenic plant of the invention is provided, the method comprising providing a seed for the transgenic plant, wherein the seed comprises a nucleic acid molecule of the invention, and treating the seed with an effective amount of a pesticide which, in combination with a polypeptide of the invention, is effective to protect a plant which grows from the seed against feeding damage by at least one or more pests to a degree greater than would be expected due to either the pesticide or the polypeptide alone.

Toxicity Assays

A whole insect assay can be used for determining toxicity. In these assays, the Vip3 polypeptides are placed on insect diet, for example, artificial diet or plant tissue, and consumed by the target insect. Those clones causing growth inhibition or mortality to the target insect can be tested in further bioassays to determine potency. In some embodiments, Vip3 genes encoding polypeptides with improved potency can be identified as those encoding polypeptides having a decreased $EC_{50}$ (concentration of polypeptide necessary to reduce insect growth by 50%) and/or $LC_{50}$ (concentration of polypeptide necessary to cause 50% mortality).

In vitro assays can also be used for screening for toxicity of the modified Vip3 polypeptides. Such assays typically involve the use of cultured insect cells that are susceptible to Vip3 polypeptides, and/or cells that express a receptor for the Vip3 polypeptides, either naturally or as a result of expression of a heterologous gene. Other in vitro assays can be used, for example, detection of morphological changes in cells, dyes and labels useful for detecting cell death, or detection of the release of ATPase by cells. One example of a suitable in vitro assay using cultured insect cells for Vip3 polypeptides toxicity is that utilizing Sf9 (*Spodoptera frugiperda*) cells. Sf9 cells are highly sensitive to Vip3 polypeptides. When Vip3 polypeptides are mixed with Sf9 cells, the cell membranes become highly permeable to small molecules. When a dye such as trypan blue is added to the cell suspension, those cells which are killed by the Vip3 polypeptide are stained blue. Thus, the cytotoxicity of the Vip3 polypeptide can be determined by image analysis.

Additional in vitro assays involve the use of receptors for the Vip3 polypeptides. One such receptor is disclosed in U.S. Pat. No. 6,291,156, herein incorporated by reference. The Vip3 polypeptide receptor can be immobilized on a receiving surface, for example, without limitation, a 96-well plate or a nitrocellulose membrane, and exposed to clones comprising the nucleotide sequences of this invention. Thus, nucleotide sequences of the invention that encode functional Vip3 polypeptides can be identified on the basis of binding affinity to the Vip3 receptor. Further, the gene encoding the Vip3 receptor can be transformed into a non-Vip3 susceptible cell line, for example the Schneider 2 (S2) *Drosophila* cell line, using methods known in the art (see for example, Clem and Miller, 1194, Mol. Cell. Biol. 14:5212-522). The transformed S2 cells can then be exposed to clones comprising nucleotide sequences of the invention. Thus, nucleotide sequences of the invention that encode functional polypeptides can be identified on the basis of induction of cell death.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1. Residue Selection Criteria for Increasing the Specific Activity of Vip3 Against European Corn Borer (ECB; *Ostrinia nubilalis*)

Vip3A (SEQ ID NO:15) is active against a wide spectrum of lepidopteran insects including black cutworm (BCW), corn earworm (CEW), tobacco budworm (TBW) and Fall armyworm (FAW), but has no activity against European corn borer (ECB).

Vip3B (SEQ ID NO:16) and Vip3D (SEQ ID NO:1) are also active against FAW and further have activity against ECB. However, Vip3B and Vip3D have a lower specific activity against ECB than, for example, Cry1Ab, which makes these proteins less attractive for a "high dose" strategy against ECB when deployed for insect control via expression in transgenic plants. Therefore, Vip3D was engineered to increase its specific activity against at least ECB.

Amino acids in Vip3D were chosen for mutagenesis based on an alignment of the amino acid sequences of Vip3A, Vip3B and Vip3D (See Table 2), the biological activity of the individual polypeptides and the following assumptions: 1) ECB activity of Vip3D is controlled by some of the amino acids that are conserved in Vip3B and Vip3D but are different in Vip3A (i.e. Vip3D=Vip3B≠Vip3A). These amino acids are termed "essentials" and are bolded in the sequence alignment disclosed in Table 2; 2) variation in ECB activity of Vip3B and Vip3D is regulated by mismatched amino acids between Vip3B and Vip3D. At these positions the amino acids in the three polypeptides are different (i.e. Vip3D≠Vip3B≠Vip3A). These amino acids are termed "synergists" and are marked in the sequence alignment of Table 2 with an "*" above the amino acid position; and 3) Vip3A has some amino acids that are identical to amino acids in Vip3B or Vip3D that may be involved in Vip3B's or Vip3D's activity against ECB (i.e. Vip3B=Vip3A≠Vip3D and Vip3D=Vip3A≠Vip3B). These residues are termed "cryptic synergists" and are underlined in the sequence alignment disclosed in Table 2. In addition, based on what is known in the art about the core toxin region of Vip3A, the core toxin region of Vip3D was assumed to include amino acids G200 (marked with an arrow in Table 2) to amino acid K787 of SEQ ID NO: 1.

TABLE 2

Alignment of Vip3 Amino Acid Sequences.

| Pos | Sequence | Start | End | Length | Matches | % Identity |
|---|---|---|---|---|---|---|
| Ref 1 | Vip3B_SEQ ID NO: 16 | 1 | 787 | 787 aa | | |
| 2 | Vip3A_SEQ ID NO: 15 | 1 | 789 | 789 aa | 649 | 82 |
| 3 | Vip3D_SEQ ID NO: 1 | 1 | 788 | 788 aa | 672 | 85 |

| | | |
|---|---|---|
| Vip3B | 1 | MNKNNTKLNARALPSFIDYFNGIYGFATGIKDIMNMIFKTDTGGNLTLDE |
| Vip3A | 1 | MNKNNTKLSTRALPSFIDYFNGIYGFATGIKDIMNMIFKTDTGGDLTLDE |
| Vip3D | 1 | MNMNNTKLNARALPSFIDYFNGIYGFATGIKDIMNMIFKTDTGGNLTLDE |

TABLE 2 -continued

Alignment of Vip3 Amino Acid Sequences.

```
Vip3B    51  ILKNQQLLNEISGKLDGVNGSLNDLIAQGNLNTELSKEILKIANEQNQVL
Vip3A    51  ILKNQQLLNDISGKLDGVNGSLNDLIAQGNLNTELSKEILKIANEQNQVL
Vip3D    51  ILKNQQLLNEISGKLDGVNGSLNDLIAQGNLNTELSKEILKIANEQNQVL

Vip3B   101  NDVNNKLNAINTMLHIYLPKITSMLNDVMKQNYALSLQIEYLSKQLQEIS
Vip3A   101  NDVNNKLDAINTMLRVYLPKITSMLSDVMKQNYALSLQIEYLSKQLQEIS
Vip3D   101  NDVNNKLDAINTMLHIYLPKITSMLSDVMKQNYALSLQIEYLSKQLQEIS
                                                              ↓
Vip3B   151  DKLDVINVNVLINSTLTEITPAYQRMKYVNEKFEDLTFATETTLKVKKNS
Vip3A   151  DKLDIINVNVLINSTLTEITPAYQRIKYVNEKFEELTFATETSSKVKKDG
Vip3D   151  DKLDIINVNVLINSTLTEITPAYQRIKYVNEKFEELTFATETTLKVKKDS

Vip3B   201  SPADILDELTELTELAKSVTKNDVDGFEFYLNTFHDVMVGNNLFGRSALK
Vip3A   201  SPADILDELTELTELAKSVTKNDVDGFEFYLNTFHDVMVGNNLFGRSALK
Vip3D   201  SPADILDELTELTELAKSVTKNDVDGFEFYLNTFHDVMVGNNLFGRSALK

Vip3B   251  TASELIAKENVKTSGSEVGNVYNFLIVLTALQAKAFLTLTTCRKLLGLAD
Vip3A   251  TASELITKENVKTSGSEVGNVYNFLIVLTALQAKAFLTLTTCRKLLGLAD
Vip3D   251  TASELIAKENVKTSGSEVGNVYNFLIVLTALQAKAFLTLTTCRKLLGLAD

Vip3B   301  IDYTFIMNEHLDKEKEEFRVNILPTLSNTFSNPNYAKAKGSNEDAKIIVE
Vip3A   301  IDYTSIMNEHLNKEKEEFRVNILPTLSNTFSNPNYAKVKGSDEDAKMIVE
Vip3D   301  IDYTSIMNEHLNKEKEEFRVNILPTLSNTFSNPNYAKVKGSDEDAKMIVE

Vip3B   351  AKPGYALVGFEMSNDSITVLKAYQAKLKQDYQVDKDSLSEIVYGDMDKLL
Vip3A   351  AKPGHALIGFEISNDSITVLKVYEAKLKQNYQVDKDSLSEVIYGDMDKLL
Vip3D   351  AKPGHALVGFEMSNDSITVLKVYEAKLKQNYQVDKDSLSEVIYGDTDKLF

Vip3B   401  CPDQSEQIYYTNNIAFPNEYVITKITFTKKMNSLRYEATANFYDSSTGDI
Vip3A   401  CPDQSEQIYYTNNIVFPNEYVITKIDFTKKMKTLRYEVTANFYDSSTGEI
Vip3D   401  CPDQSEQIYYTNNIVFPNEYVITKIDFTKKMKTLRYEVTANFYDSSTGEI

Vip3B   451  DLNKTKVESSEAEYSTLSASTDGVYMPLGIISETFLTPINGFGIVVDENS
Vip3A   451  DLNKKKVESSEAEYRTLSANDDGVYMPLGVISETFLTPINGFGLQADENS
Vip3D   451  DLNKKKVESSEAEYRTLSANDDGVYMPLGVISETFLTPINGFGLQADENS

Vip3B   501  KLVNLTCKSYLREVLLATDLSNKETKLIVPPIGFISNIVENGNLEGENLE
Vip3A   501  RLITLTCKSYLRELLLATDLSNKETKLIVPPSGFISNIVENGSIEEDNLE
Vip3D   501  RLITLTCKSYLRELLLATDLSNKETKLIVPPSGFISNIVENGSIEEDNLE

Vip3B   551  PWKANNKNAYVDHTGGVNGTKALYVHKDGEFSQFIGDKLKSKTEYVIQYI
Vip3A   551  PWKANNKNAYVDHTGGVNGTKALYVHKDGGISQFIGDKLKPKTEYVIQYT
Vip3D   551  PWKANNKNAYVDHTGGVNGTKALYVHKDGGFSQFIGDKLKPKTEYVIQYT

Vip3B   601  VKGKASILLKDEKNGDCIYEDTNNGLEDFQTITKSFITGTDSSGVHLIFN
Vip3A   601  VKGKPSIHLKDENTGYIHYEDTNNNLEDYQTINKRFTTGTDLKGVYLILK
Vip3D   601  VKGKPSIHLKDENTGYIHYEDTNNNLKDYQTITKRFTTGTDLKGVYLILK

*       * * * * *     *
Vip3B   651  SQNGDEAFGENFTISEIRLSEDLLSPELINSDAWVGSQGTWISGNSLTIN
Vip3A   651  SQNGDEAWGDNFIILEISPSEKLLSPELINTNNWTSTGSTNISGNTLTLY
Vip3D   651  SQNGDEAWGDKFTILEIKPAEDLLSPELINPNSWITTPGASISGNKLFIN

* *       *       *    * *       *              * *** *
Vip3B   701  SNVNGTFRQNLSLESYSTYSMNFNVNGFAKVTVRNSREVLFEKNYPQLSP
Vip3A   701  QGGRGILKQNLQLDSFSTYRVYFSVSGDANVRIRNSREVLFEKRYMSG-A
Vip3D   701  LGTNGTFRQSLSLNSYSTYSISFTASGPFNVTVRNSREVLFERSNLMSST

*   **        ***
Vip3B   751  KDISEKFTTAANNTGLYVELSR---FTSGGAINFRNFSIK
Vip3A   750  KDVSEMFTTKFEKDNFYIELSQGNNLYGGPIVHFYDVSIK
Vip3D   751  SHISGTFKTESNNTGLYVELSR--RSGGGHISFENVSIK
```

Using these criteria, 33 "essentials," 28 "synergists" and 74 "cryptic synergists" were identified as the best candidates for mutational analysis. The selected amino acids are shown in Table 3.

TABLE 3

Residues for Modification (same data as shown in Table 1, supra)

| Essentials (33) | | Synergists (28) | | Cryptic Synergists (80) | | | |
|---|---|---|---|---|---|---|---|
| S200 | N763 | K668 | G775 | N312 | A496 | L642 | H752 |
| A257 | T764 | P681 | H779 | V338 | R501 | K643 | G755 |
| K284 | G765 | S683 | S781 | D342 | I503 | L649 | K758 |
| V358 | L766 | T686 | E783 | M347 | T504 | K650 | G776 |
| M362 | V768 | P688 | | H355 | L514 | W658 | V785 |
| F581 | R772 | S691 | | V372 | S532 | D660 | |
| T633 | G778 | K696 | | E374 | S543 | K661 | |
| T663 | I780 | L701 | | N380 | I544 | L665 | |
| D672 | N784 | T703 | | V391 | E546 | P669 | |
| G689 | | N714 | | I392 | D547 | A670 | |
| I699 | | I721 | | F400 | G580 | N682 | |
| N700 | | S722 | | V415 | P591 | I685 | |
| N704 | | T724 | | D426 | T600 | T687 | |
| T706 | | P728 | | K432 | P605 | A690 | |
| F707 | | S744 | | T433 | H608 | F698 | |
| R708 | | L746 | | V438 | N613 | G702 | |
| S712 | | M747 | | E449 | T614 | S710 | |
| Y716 | | S748 | | K455 | Y616 | A725 | |
| S720 | | T750 | | R465 | I617 | S726 | |
| T732 | | T756 | | N470 | H618 | F729 | |
| V733 | | E760 | | D471 | N625 | N730 | |
| S749 | | S761 | | V480 | Y629 | R743 | |
| I753 | | R773 | | L494 | R635 | N745 | |
| N762 | | S774 | | Q495 | T637 | S751 | |

Example 2. Residue Substitution

Mutant vip3D coding sequences, derived from the wild-type parent vip3D coding sequence of SEQ ID NO: 1, were constructed using a QuikChange® Site-Directed Mutagenesis Kit (Stratagene, La Jolla, Calif.). Mutagenesis primers were designed for providing specific point mutations using skills known in the art and did not always follow the manufacturer's suggested parameters for such design. The template for the mutagenesis reactions was the wild-type vip3D coding sequence (SEQ ID NO: 1) in a vector that provides a 6× Histidine (6-His) tag as well as a short epitope sequence GMASMATGGQQMGRDLYDDDDKDPTL (SEQ ID NO: 453) for probing with antibodies at the N-terminus of the expressed mutant polypeptide. Briefly, the mutagenesis method comprises denaturing the vector comprising the vip3D coding sequence and anneling the denatured plasmid with the mutagensis primers containing the desired mutation. Using the nonstrand-displacing action of PfuTurbo® DNA polymerase (Stratagene, La Jolla, Calif.), the mutagenic primers were extended and incorporated resulting in nicked circular strands. The methylated, non-mutated parental DNA template is digested with the restriction ezyme Dpn I and the circular, nicked dsDNA is transformed into XL1-Blue or comparable supercompetent cells.

Initially, alanine substitutions were made at the positions identified as cryptic, essential and synergistic. Primers are typically from about 27 to about 46 nucleotides in length and the forward primers are typically designed with the following general formula: $X_1$gcg$X_2$, where cgc is the codon that encodes alanine and where $X_1$ is a contiguous stretch of nucleotides 5' of the native vip3D codon to be mutated and $X_2$ is a contiguous stretch of nucleotides 3' of the native vip3D codon to be mutated. $X_1$ typically comprises from 13 to 26 nucleotides and $X_2$ typically comprises from 11 to 19 nucleotides. The reverse primers are the reverse complement of the forward primers. For example, to make an alanine substitution at position K668 of SEQ ID NO: 15, the forward primer 5'-TACAATTTTAGAAATTgcgCCTGCGGAGGATTT-3' (SEQ ID NO: 131) and the reverse primer 5'-AAATCCTCCGCAGGcgcAATTTCTAAAATTGTA-3' (SEQ ID NO: 132) are used. Examples of other primers designed in this way for some of the positions to be mutated but not all are shown in Table 4. The skilled person will recognize that Table 4 is meant to provide non-limiting examples of some primers useful in the invention and that other primer sequences may be used.

TABLE 4

Examples of $X_1$cgc$X_2$ primers for making alanine substitutions.

| Name | Forward Primer (5'→3') | SEQ ID NO: | Reverse Primer (5'→3') | SEQ ID NO: |
|---|---|---|---|---|
| K668A | TACAATTTTAGAAATTgcgCCTGCGGAGGATTT | 131 | AAATCCTCCGCAGGcgcAATTTCTAAAATTGTA | 132 |
| P681A | CCAGAATTAATTAATgcgAATTCTTGGATTACG | 133 | CGTAATCCAAGAATTcgcATTAATTAATTCTGG | 134 |
| S683A | TAATTAATCCGAATgcgTGGATTACGAC | 135 | GTCGTAATCCAcgcATTCGGATTAATTA | 136 |
| T686A | GAATTCTTGGATTgcgACTCCAGGGGC | 137 | GCCCCTGGAGTcgcAATCCAAGAATTC | 138 |
| P688A | CTTGGATTACGACTgcgGGGGCTAGCATTTC | 139 | GAAATGCTAGCCCCcgcAGTCGTAATCCAAG | 140 |
| S691A | GACTCCAGGGGCTgcgATTTCAGGAAATAAAC | 141 | GTTTATTTCCTGAAATcgcAGCCCCTGGAGTC | 142 |
| K696A | GCATTTCAGGAAATgcgCTTTTCATTAAC | 143 | GTTAATGAAAAGcgcATTTCCTGAAATGC | 144 |
| L701A | GGAAATAAACTTTTCATTAACgcgGGGACAAATGGGACC | 145 | GGTCCCATTTGTCCCcgcGTTAATGAAAAGTTTATTTCC | 146 |
| T703A | CTTTTCATTAACTTGGGGgcgAATGGGACCTTTAG | 147 | CTAAAGGTCCCATTcgcCCCCAAGTTAATGAAAAG | 148 |
| N714A | GGACCTTTAGACAAAGTCTTTCATTAgcgAGTTATTCAACT TATAG | 149 | CTATAAGTTGAATAACTcgcTAATGAAAGACTTTGTCTA AAGGTCC | 150 |
| I721A | CAACTTATAGTgcgAGCTTTACTGCATC | 151 | GATGCAGTAAAGCTcgcACTATAAGTTG | 152 |
| S722A | GTTATTCAACTTATAGTATAgcgTTTACTGCATCAGGACC | 153 | GGTCCTGATGCAGTAAAcgcTATACTATAAGTTGAATAAC | 154 |

TABLE 4 -continued

Examples of X₁cgcX₂ primers for making alanine substitutions.

| Name | Forward Primer (5'→3') | SEQ ID NO: | Reverse Primer (5'→3') | SEQ ID NO: |
|---|---|---|---|---|
| T724A | CTTATAGTATAAGCTTTgcgGCATCAGGACCATTTAATGTG | 155 | CACATTAAATGGTCCTGATGCcgcAAAGCTTATACTATAAG | 156 |
| P728A | GCTTTACTGCATCAGGAgcgTTTAATGTGACGGTAAG | 157 | CTTACCGTCACATTAAAcgcTCCTGATGCAGTAAAGC | 158 |
| S744A | GTATTATTTGAACGAgcgAACCTTATGTCTTC | 159 | GAAGACATAAGGTTcgcTCGTTCAAATAATAC | 160 |
| L746A | GAACGAAGCAACgcgATGTCTTCAACTAGTC | 161 | GACTAGTTGAAGACATcgcGTTGCTTCGTTC | 162 |
| M747A | GAACGAAGCAACCTTgcgTCTTCAACTAGTCATATTTC | 163 | GAAATATGACTAGTTGAAGAcgcAAGGTTGCTTCGTTC | 164 |
| S748A | GAACGAAGCAACCTTATGgcgTCAACTAGTCATATTTC | 165 | GAAATATGACTAGTTGAcgcCATAAGGTTGCTTCGTTC | 166 |
| T750A | CCTTATGTCTTCAgcgAGTCATATTTCTG | 167 | CAGAAATATGACTcgcTGAAGACATAAGG | 168 |
| T756A | CTAGTCATATTTCTGGGgcgTTCAAAACTGAATCC | 169 | GGATTCAGTTTTGAAcgcCCCAGAAATATGACTAG | 170 |
| E760A | GGACATTCAAAACTgcgTCCAATAATACCGG | 171 | CCGGTATTATTGGAcgcAGTTTTGAATGTCC | 172 |
| S761A | CATTCAAAACTGAAgcgAATAATACCGGATTATATG | 173 | CATATAATCCGGTATTATTcgcTTCAGTTTTGAATG | 174 |
| R773A | GTAGAACTTTCCCGTgcgTCTGGTGGTGGTGG | 175 | CCACCACCACCAGAcgcACGGGAAAGTTCTAC | 176 |
| S774A | CTTTCCCGTCGCgcgGGTGGTGGTGGTC | 177 | GACCACCACCACCcgcGCGACGGGAAAG | 178 |
| G775A | GAACTTTCCCGTCGCTCTgcgGGTGGTGGTCATATATC | 179 | GATATATGACCACCACCcgcAGAGCGACGGGAAAGTTC | 180 |
| H779A | GGTGGTGGTGGTgcgATATCATTTGAAAAC | 181 | GTTTTCAAATGATATcgcACCACCACCACC | 182 |
| S781A | GGTGGTGGTCATATAgcgTTTGAAAACGTTTC | 183 | GAAACGTTTTCAAAcgcTATATGACCACCACC | 184 |
| E783A | GGTCATATATCATTTgcgAACGTTTCTATTAAA | 185 | TTTAATAGAAACGTTcgcAAATGATATATGACC | 186 |
| A257A | CTGCTTCAGAATTAATTgcgAAAGAAAATGTG | 187 | CACATTTTCTTTcgcAATTAATTCTGAAGCAG | 188 |
| M362A | CATTGGTTGGGTTTGAAgcgAGCAATGATTCAATCAC | 189 | GTGATTGAATCATTGCTcgcTTCAAACCCAACCAATG | 190 |
| T633A | GATTATCAAACTATTgcgAAACGTTTTACTACAGG | 191 | CCTGTAGTAAAACGTTTcgcAATAGTTTGATAATC | 192 |
| T663A | CTTGGGGAGATAAATTTgcgATTTTAGAAATTAAGCC | 193 | GGCTTAATTTCTAAAATcgcAAATTTATCTCCCCAAG | 194 |
| N700A | GGAAATAAACTTTTCATTgcgTTGGGGACAAATGGGAC | 195 | GTCCCATTTGTCCCCAAcgcAATGAAAAGTTTATTTCC | 196 |
| T706A | CTTGGGGACAAATGGGgcgTTTAGACAAAGTCTTTC | 197 | GAAAGACTTTGTCTAAAcgcCCCATTTGTCCCCAAG | 198 |
| S712A | CCTTTAGACAAAGTCTTgcgTTAAACAGTTATTCAAC | 199 | GTTGAATAACTGTTTAAcgcAAGACTTTGTCTAAAGG | 200 |
| Y716A | GTCTTTCATTAAACAGTgcgTCAACTTATAGTATAAGC | 201 | GCTTATACTATAAGTTGAcgcACTGTTTAATGAAAGAC | 202 |
| S720A | CAGTTATTCAACTTATgcgATAAGCTTTACTGCATC | 203 | GATGCAGTAAAGCTTATcgcATAAGTTGAATAACTG | 204 |
| T732A | GGACCATTTAATGTGgcgGTAAGAAATTCTAGG | 205 | CCTAGAATTTCTTACcgcCACATTAAATGGTCC | 206 |
| S749A | GAAGCAACCTTATGTCTgcgACTAGTCATATTTCTGG | 207 | CCAGAAATATGACTAGTcgcAGACATAAGGTTGCTT | 208 |
| T764A | CAAAACTGAATCCAATAATgcgGGATTATATGTAGAAC | 209 | GTTCTACATATAATCCcgcATTATTGGATTCAGTTTTG | 210 |
| G765A | CTGAATCCAATAATACCgcgTTATATGTAGAACTTTC | 211 | GAAAGTTCTACATATAAcgcGGTATTATTGGATTCAG | 212 |
| S200A | CTTTAAAAGTAAAAAGGATgcgTCGCCTGCTGATATTCTTG | 213 | CAAGAATATCAGCAGGCGAcgcATCCTTTTTACTTTTAAAG | 214 |
| K284A | CAGCTCTACAAGCAgcgGCTTTTCTTACTTTAAC | 215 | GTTAAAGTAAGAAAAGCcgcTGCTTGTAGAGCTG | 216 |
| V358A | CCAGGACATGCATTGgcgGGGTTTGAAATGAGC | 217 | GCTCATTTCAAACCCcgcCAATGCATGTCCTGG | 218 |
| F581A | CATAAGGACGGAGGAgcgTCACAATTTATTGGAG | 219 | CTCCAATAAATTGTGAcgcTCCTCCGTCCTTATG | 220 |
| D672A | GAAATTAAGCCTGCGGAGgcgTTATTAAGCCCAG | 221 | CTGGGCTTAATAAcgcCTCCGCAGGCTTAATTTC | 222 |
| G689A | GGATTACGACTCCAgcgGCTAGCATTTCAGG | 223 | CCTGAAATGCTAGCcgcTGGAGTCGTAATCC | 224 |
| I699A | CAGGAAATAAACTTgcgATTAACTTGGGGACAAATGGG | 225 | CCCATTTGTCCCCAAGTTAATcgcAAGTTTATTTCCTG | 226 |
| N704A | CATTAACTTGGGGACAgcgGGGACCTTTAGACAAAG | 227 | CTTTGTCTAAAGGTCCCcgcTGTCCCCAAGTTAATG | 228 |

TABLE 4 -continued

Examples of X₁cqcX₂ primers for making alanine substitutions.

| Name | Forward Primer (5'→3') | SEQ ID NO: | Reverse Primer (5'→3') | SEQ ID NO: |
|---|---|---|---|---|
| F707A | GGGACAAATGGGACCgcgAGACAAAGTCTTTC | 229 | GAAAGACTTTGTCTcgcGGTCCCATTTGTCCC | 230 |
| R708A | GACAAATGGGACCTTTgcgCAAAGTCTTTCATTAAAC | 231 | GTTTAATGAAAGACTTTGcgcAAAGGTCCCATTTGTC | 232 |
| V733A | GGACCATTTAATGTGACGgcgAGAAATTCTAGGGAAG | 233 | CTTCCCTAGAATTTCTcgcCGTCACATTAAATGGTCC | 234 |
| I753A | GTCTTCAACTAGTCATgcgTCTGGGACATTCAAAACTG | 235 | CAGTTTTGAATGTCCCAGAcgcATGACTAGTTGAAGAC | 236 |
| N762A | GACATTCAAAACTGAATCCgcgAATACCGGATTATATGTAG | 237 | CTACATATAATCCGGTATTcgcGGATTCAGTTTTGAATGTC | 238 |
| N763A | CATTCAAAACTGAATCCAATgcgACCGGATTATATGTAGAAC | 239 | GTTCTACATATAATCCGGTcgcATTGGATTCAGTTTTGAATG | 240 |
| L766A | GAATCCAATAATACCGGAgcgTATGTAGAACTTTCCCG | 241 | CGGGAAAGTTCTACATAcgcTCCGGTATTATTGGATTC | 242 |
| V768A | CAATAATACCGGATTATATgcgGAACTTTCCCGTCGCTCTG | 243 | CAGAGCGACGGGAAAGTTCcgcATATAATCCGGTATTATTG | 244 |
| R772A | GTAGAACTTTCCgcgCGCTCTGGTGGTGGTG | 245 | CACCACCACCAGAGCGcgcGGAAAGTTCTAC | 246 |
| G778A | CGCTCTGGTGGTGGTgcgCATATATCATTTG | 247 | CAAATGATATATGcgcACCACCACCAGAGCG | 248 |
| I780A | GGTGGTGGTGGTCATgcgTCATTTGAAAACGTTTC | 249 | GAAACGTTTTCAAATGAcgcATGACCACCACCACC | 250 |
| N784A | GTCATATATCATTTGAAgcgGTTTCTATTAAATAAAAGGG | 251 | CCCTTTTATTTAATAGAAACcgcTTCAAATGATATATGAC | 252 |

Accordingly, as one of skill in the art would recognize, primers can be prepared for substituting other amino acid codons in Vip3 polypeptides or any amino acid codon in any polypeptide of interest using the formula of $X_1nnnX_2$ (n=any nucleotide; $X_1$=contiguous stretch of about 13 to 26 nucleotides 5' of the codon to be mutated; $X_2$=contiguous stretch of about 11 to 19 nucleotides 3' of the codon to be mutated), as described herein.

Other primers are designed to change a base at the first or second position or both the first and second positions of the native vip3D codon to be mutated. For example, to make an alanine substitution at position V785 of SEQ ID NO: 1, a forward primer 5'-CATATATCATTTGAAAACGcTTCTAT-TAAATAAAAG-3' (SEQ ID NO: 253) and a reverse primer 5'-CTTTTATTTAATAGAAgCGTTTTCAAATGA-TATATG-3' (SEQ ID NO: 254) may be used, where small case "c" in the forward primer and small case "g" in the reverse primer designate the mutated base pair in the codon encoding V785. Examples of other primers designed in this way for some of the positions to be mutated but not all are shown in Table 5. The skilled person will recognize that different primer sequences for Vip polypeptides (or any other polypeptides of interest) may be designed and used in this manner (formula $X_1n_{1-2}X_2$; n=the first and/or second nucleotide of the codon to be mutated; $X_1$=contiguous stretch of about 13 to 26 nucleotides 5' of the nucleotide(s) to be mutated; $X_2$=contiguous stretch of about 11 to 19 nucleotides 3' of the nucleotide(s) to be mutated)) and that Table 5 is meant to provide non-limiting examples of some primers useful in the invention.

TABLE 5

Examples of primers for changing first and/or second position of mutated vip3 codon.

| Name | Forward Primer (5'→3') | SEQ ID NO: | Reverse Primer (5'→3') | SEQ ID NO: |
|---|---|---|---|---|
| V785A | CATATATCATTTGAAAACGcTTCTATTAAATAAAAG | 253 | CTTTTATTTAATAGAAgCGTTTTCAAATGATATATG | 254 |
| G776A | TCCCGTCGCTCTGGTGcTGGTGGTCATATATCA | 255 | TGATATATGACCACCAgCACCAGAGCGACGGGA | 256 |
| K758A | ATTTCTGGGACATTCGcAACTGAATCCAATAAT | 257 | ATTATTGGATTCAGTTgcGAATGTCCCAGAAAT | 258 |
| S751A | CTTATGTCTTCAACTgcTCATATTTCTGGGAC | 259 | GTCCCAGAAATATGAgcAGTTGAAGACATAAG | 260 |
| N745A | TTATTTGAACGAAGCgcCCTTATGTCTTCAAC | 261 | GTTGAAGACATAAGGgcGCTTCGTTCAAATAA | 262 |
| R743A | GAAGTATTATTTGAAgcAAGCAACCTTATGTC | 263 | GACATAAGGTTGCTTgcTTCAAATAATACTTC | 264 |
| F729A | CTGCATCAGGACCAgcTAATGTGACGGTAAG | 265 | CTTACCGTCACATTAgcTGGTCCTGATGCAG | 266 |
| S726A | GTATAAGCTTTACTGCAgCAGGACCATTTAATG | 267 | CATTAAATGGTCCTGcTGCAGTAAAGCTTATAC | 268 |
| G702A | CTTTTCATTAACTTGGcGACAAATGGGACCTTT | 269 | AAAGGTCCCATTTGTCgCCAAGTTAATGAAAAG | 270 |

TABLE 5 -continued

Examples of primers for changing first and/or second position of mutated vip3 codon.

| Name | Forward Primer (5'→3') | SEQ ID NO: | Reverse Primer (5'→3') | SEQ ID NO: |
|---|---|---|---|---|
| F698A | CAGGAAATAAACTTgcCATTAACTTGGGGAC | 271 | GTCCCCAAGTTAATGgcAAGTTTATTTCCTG | 272 |
| L665A | GATAAATTTACAATTgcAGAAATTAAGCCTGC | 273 | GCAGGCTTAATTTCTgcAATTGTAAATTTATC | 274 |
| K661A | GAAGCTTGGGGAGATgcATTTACAATTTTAG | 275 | CTAAAATTGTAAATgcATCTCCCCAAGCTTC | 276 |
| D660A | GAAGCTTGGGGAGcTAAATTTACAATTT | 277 | AAATTGTAAATTTAgCTCCCCAAGCTTC | 278 |
| W658A | CAAAATGGAGATGAAGCTgcGGGAGATAAATTTACAA | 279 | TTGTAAATTTATCTCCCgcAGCTTCATCTCCATTTTG | 280 |
| L649A | GGGAGTGTATTTAATTgcAAAAAGTCAAATGG | 281 | CCATTTTGACTTTTTgcAATTAAATACACTCCC | 282 |
| K643A | CTACAGGAACTGATTTAgcGGGAGTGTATTTAATTT | 283 | AAATTAAATACACTCCCgcTAAATCAGTTCCTGTAG | 284 |
| L642A | TTACTACAGGAACTGATgcAAAGGGAGTGTATTT | 285 | AAATACACTCCCTTTgcATCAGTTCCTGTAGTAA | 286 |
| T637A | CTATTACTAAACGTTTTgCTACAGGAACTGATTTA | 287 | TAAATCAGTTCCTGTAGcAAAACGTTTAGTAATAG | 288 |
| Y629A | TAATAATTTAAAAGATgcTCAAACTATTACTAAACG | 289 | CGTTTAGTAATAGTTTGAgcATCTTTTAAATTATTA | 290 |
| N625A | GAAGATACAAATAATgcTTTAAAAGATTATCA | 291 | TGATAATCTTTTAAAgcATTATTTGTATCTTC | 292 |
| H618A | ATACTGGATATATTgcTTATGAAGATACAA | 293 | TTGTATCTTCATAAgcAATATATCCAGTAT | 294 |
| I617A | GAAAATACTGGATATgcTCATTATGAAGATAC | 295 | GTATCTTCATAATGAgcATATCCAGTATTTTC | 296 |
| T614A | CATTTAAAAGATGAAAATgCTGGATATATTCATTATG | 297 | CATAATGAATATATCCAGcATTTTCATCTTTTAAATG | 298 |
| H608A | GGAAAACCTTCTATTgcTTTAAAAGATGAAAATAC | 299 | GTATTTTCATCTTTTAAAgcAATAGAAGGTTTTCC | 300 |
| T600A | GTATGTAATCCAATATgCTGTTAAAGGAAAACC | 301 | GGTTTTCCTTTAACAgCATATTGGATTACATAC | 302 |
| P591A | GGAGATAAGTTAAAgCGAAAACTGAGTATG | 303 | CATACTCAGTTTTCGcTTTTAACTTATCTCC | 304 |
| D547A | CGGGTCCATAGAAGAGGcCAATTTAGAGCCGTGG | 305 | CCACGGCTCTAAATTGgCCTCTTCTATGGACCCG | 306 |
| I544A | TGTAGAGAACGGGTCCgcAGAAGAGGACAATTTAG | 307 | CTAAATTGTCCTCTTCTgcGGACCCGTTCTCTACA | 308 |
| S543A | TATTGTAGAGAACGGGgCCATAGAAGAGGACAA | 309 | TTGTCCTCTTCTATGGcCCCGTTCTCTACAATA | 310 |
| S532A | CTAAATTGATCGTCCCACCAgcTGGTTTTATTAGCAATATTG | 311 | CAATATTGCTAATAAAACCAgcTGGTGGGACGATCAATTTAG | 312 |
| L514A | CATATTTAAGAGAAgCACTGCTAGCAACAG | 313 | CTGTTGCTAGCAGTgcTTCTCTTAAATATG | 314 |
| T504A | GAAAATTCAAGATTAATTgCTTTAACATGTAAATCAT | 315 | ATGATTTACATGTTAAAGcAATTAATCTTGAATTTTC | 316 |
| I503A | GAAAATTCAAGATTAgcTACTTTAACATGTAAATC | 317 | GATTTACATGTTAAAGTAgcTAATCTTGAATTTTC | 318 |
| R501A | GCTGATGAAAATTCAgcATTAATTACTTTAAC | 319 | GTTAAAGTAATTAATgcTGAATTTTCATCAGC | 320 |
| Q495A | GATAAATGGGTTTGGCCTCgcAGCTGATGAAAATTCAAG | 321 | CTTGAATTTTCATCAGCTgcGAGGCCAAACCCATTTATC | 322 |
| L494A | GATAAATGGGTTTGGCgcCCAAGCTGATGAAAATTC | 323 | GAATTTTCATCAGCTTGGgcGCCAAACCCATTTATC | 324 |
| V480A | GTATATGCCATTAGGTGcCATCAGTGAAACATTT | 325 | AAATGTTTCACTGATGgCACCTAATGGCATATAC | 326 |
| F400A | GATACGGATAAATTAgcTTGTCCAGATCAATC | 327 | GATTGATCTGGACAAgcTAATTTATCCGTATC | 328 |
| T396A | GGTTATTTATGGTGATgCGGATAAATTATTTTG | 329 | CAAAATAATTTATCCGcATCACCATAAATAACC | 330 |
| I392A | CCTTATCGGAGGTTgcTTATGGTGATACGG | 331 | CCGTATCACCATAAgcAACCTCCGATAAGG | 332 |
| V391A | GGATTCCTTATCGGAGGcTATTTATGGTGATACGG | 333 | CCGTATCACCATAAATAgCCTCCGATAAGGAATCC | 334 |
| H355A | GTGGAAGCTAAACCAGGAgcTGCATTGGTTGGGTTTG | 335 | CAAACCCAACCAATGCAgcTCCTGGTTTAGCTTCCAC | 336 |
| M347A | GTGATGAAGATGCAAAGgcGATTGTGGAAGCTAAACC | 337 | GGTTTAGCTTCCACAATCgcCTTTGCATCTTCATCAC | 338 |

Double alanine mutants may also be made and tested according to the methods disclosed herein. Some embodiments of such double mutants that were made include I544A+S712A, K455A+V338A, H618A+T750A, L701A+I721A, S722A+S781A, S761A+S744A, S781A+S744A and S781A+T750A. Double mutants were made by mutating a first position with primers designed as described above in a PCR reaction, confirmed to be correct, and then in a subsequent PCR reaction, using DNA from the first mutant as a template, mutating a second position using primers designed as described above.

Example 3. Bioassay of Vip3D Alanine Mutant Proteins

The single and double alanine-substituted Vip3D mutant polypeptides described in Example 2 were tested against European corn borer (ECB) and fall armyworm (FAW) using an art-recognized artificial diet bioassay method. Briefly, *E. coli* clones each expressing one of the mutant Vip3D polypeptides was grown overnight. The overnight culture was sonicated and the amount of polypeptide in inclusion bodies was determined. An equal amount of polypeptide solution from each mutant clone was then applied to the surface of an artificial insect diet (Bioserv, Inc., Frenchtown, N.J.) in small petri-dishes. After the diet surface dried, ECB or FAW larvae were added to each plate. The plates were sealed and maintained at ambient laboratory conditions with regard to temperature, lighting and relative humidity A positive-control group consists of ECB or FAW larvae exposed to a wild-type Vip3D polypeptide. Negative control groups consist of ECB or FAW larvae exposed to the insect diet without a test substance (diet alone) and insect diet treated with a vector-minus *E. coli* protein solution (i.e. no Vip3D polypeptide). Mortality was assessed after about 120 hours and scored relative to the wild-type Vip3D polypeptide. Any polypeptides showing either an increase or a decrease in activity were retained. Those mutants with substitutions having no effect (i.e. activity was comparable to wild-type Vip3D) or those for which no polypeptide was expressed were discarded.

The results of the bioassays on the alanine mutants of Vip3D, part of which are shown in Table 6, show that alanine mutantations at amino acid positions V338, K455, D471, Q495, R501, S543, I544, G580, P591, P605, H608, Y616, I617, H618, R635, K643, W658, P681, S712, I753, E760, V768A, 5774, G775, and H779 had a significantly higher specific activity against ECB than the wild-type Vip3D polypeptide from which the mutants were derived. The alanine mutants at position E374, V415, T433, V438, E449, V480, L649, D672, N700, Y716, 5722, N763, I780 and 5781 were found not to have significantly different toxicity to ECB when compared to the wild-type Vip3D polypeptide. The Vip3D polypeptides with alanine mutations at amino acid positions L514, E546, T614, T724, T743, 5744, T756, S761 T764, G778 and V785 were found to have lower toxicity to ECB when compared to the wild-type Vip3D polypeptide. Furthermore, alanine substitutions of amino acids at positions M362, V372, F400 R465, L494, I503, 5532, T600, N625, Y629, K650, N682, 5683, G689, L701, M747, L766 and R773 knocked out ECB activity completely. Therefore, the results clearly show that certain amino acids in a Vip3 protein play a role in that protein's activity against at least European corn borer. Most of the alanine mutations had no impact on FAW activity. However, an alanine substitution at amino acids V372 and G689 knocked out or significantly reduced activity of Vip3D against FAW. These same mutations knocked out ECB activity completely. This is an indication that these amino acids may play an important role for Vip3 toxicity in general.

TABLE 6

Results of bioassays of alanine mutant Vip3D polypeptides.

| Mutation Vip3D | Activity ECB | FAW |
|---|---|---|
| (Parent) | ++ | +++ |
| Cryptic Synergists | | |
| V338A | +++ | +++ |
| V372A | − | − |
| E374A | ++ | +++ |
| F400A | − | +++ |
| V415A | ++ | +++ |
| T433A | ++ | +++ |
| V438A | ++ | +++ |
| E449A | ++ | +++ |
| K455A | +++ | +++ |
| R465A | − | +++ |
| N470A | ++ | +++ |
| D471A | +++ | +++ |
| V480A | ++ | ++ |
| L494A | − | +++ |
| Q495A | +++ | +++ |
| R501A | +++ | +++ |
| I503A | − | +++ |
| L514A | + | +++ |
| S532A | − | +++ |
| S543A | +++ | +++ |
| I544A | +++ | +++ |
| E546A | + | +++ |
| G580A | +++ | +++ |
| P591A | +++ | +++ |
| T600A | − | +++ |
| P605A | +++ | +++ |
| H608A | +++ | +++ |
| T614A | + | +++ |
| Y616A | +++ | +++ |
| I617A | +++ | +++ |
| H618A | +++ | +++ |
| N625A | − | +++ |
| Y629A | − | +++ |
| R635A | +++ | +++ |
| K643A | +++ | +++ |
| L649A | ++ | +++ |
| K650A | − | +++ |
| W658A | +++ | +++ |
| N682A | − | +++ |
| T743A | + | +++ |
| V785A | + | +++ |
| Synergists | | |
| P681A | +++ | +++ |
| S683A | − | +++ |
| L701A | − | +++ |
| S722A | ++ | +++ |
| T724A | + | +++ |
| S744A | + | +++ |
| M747A | − | +++ |
| T756A | + | +++ |
| E760A | +++ | +++ |
| S761A | + | +++ |
| R773A | − | +++ |
| S774A | +++ | +++ |
| G775A | +++ | +++ |
| H779A | +++ | +++ |
| S781A | ++ | +++ |
| Essentials | | |
| M362A | − | +++ |
| G689A | − | + |
| D672A | ++ | +++ |
| N700A | ++ | +++ |
| S712A | +++ | +++ |
| Y716A | ++ | +++ |
| I753A | +++ | +++ |
| N763A | ++ | +++ |
| T764A | + | +++ |
| L766A | − | +++ |
| V768A | +++ | +++ |

TABLE 6-continued

Results of bioassays of alanine mutant Vip3D polypeptides.

|  | Activity | |
|---|---|---|
| Mutation Vip3D | ECB | FAW |
| (Parent) | ++ | +++ |
| G778A | + | +++ |
| I780A | ++ | +++ |

Table 7 shows the results of double-mutant bioassays. All double mutants maintained their activity against FAW. Double mutants K455A+V338A, I544A+S712A and H618A+T750A were as active against ECB and FAW as their single mutant counterparts. However, double mutants S722A+S781A, S761A+S744A, S781A+S744A and S781A+T750A were less active against ECB than their single mutant counterparts. Further, combining mutations L701A+I721A knocked out ECB activity even though their single mutant counterparts had greater ECB activity than the wild-type Vip3D protein.

TABLE 7

Results of double mutant bioassays.

| Double Mutation | Activity | | Category of Amino Acid at Mutated Position |
|---|---|---|---|
|  | ECB | FAW |  |
| Vip3D (Parent) | ++ | +++ |  |
| K455A + V338A | +++ | +++ | cryptic + cryptic |
| I544A + S712A | +++ | +++ | cryptic + essential |
| H618A + T750A | +++ | +++ | cryptic + synergist |
| L701A + I721A | − | +++ | synergist + synergist |
| S722A + S781A | + | +++ | synergist + synergist |
| S761A + S744A | + | +++ | synergist + synergist |
| S781A + S744A | + | +++ | synergist + synergist |
| S781A + T750A | + | +++ | synergist + synergist |

Example 4. Residue Spin

The amino acids identified above as playing a critical role in ECB activity are now replaced by any of the known 20 amino acids (herein named "residue spin"), so as to identify at a critical position the best performing amino acid, i.e. yielding a Vip3D polypeptide with higher specific activity to ECB and/or an improved spectrum of pesticidal activity. Several amino acid characteristics can be used to prioritize which amino acids would be used in the spin residue mutations. For example, amino acids can be ranked by importance to possible effects on target organism gut receptor binding with hydrophobicity>charge>size.

The procedure to generate the residue spin mutants at certain amino acid positions is essentially identical to the procedure used to construct the alanine mutants as described in Example 2, except that different primer pairs are used. Primers used in the residue spin mutations are typically from about 27 to about 40 nucleotides in length. The forward primers are designed to change a base at a first, second and/or third position or any combination thereof, of the native vip3D codon to be mutated and typically have the following general formula: $X_1NX_2$, where N is from one to three mutated bases of the mutated codon and where $X_1$ is a contiguous stretch of nucleotides 5' of the native vip3D base(s) to be mutated and $X_2$ is a contiguous stretch of nucleotides 3' of the native vip3D base(s) to be mutated. The reverse primers are the reverse complement of the forward primers. For example, without limitation, to change the valine (V) at position 338 of SEQ ID NO: 1 to a threonine (T), a forward primer 5'-CCTAATTATG-CAAAAacTAAAGGAAGTGATGAAG-3' (SEQ ID NO:339) and a reverse primer 5'-CTTCATCACTTCCTT-TAGTTTTTGCATAATTAGG-3' (SEQ ID NO:340) may be used, where small case "ac" in the forward primer designate the mutated bases in the codon encoding V338. Examples of additional primers designed in this way for some of the positions to be mutated by residue spin are shown in Table 8. The skilled person will recognize that primer sequences different from those shown in Table 8 may be designed and used in this manner and that Table 8 provides only a non-limiting example of some primers useful with the invention. Using these examples, the skilled person can mutate any position in a protein of interest.

TABLE 8

Primers useful for residue spin mutations.

| Name | Forward Primer (5'→3') | SEQ ID NO: | Reverse Primer (5'→3') | SEQ ID NO: |
|---|---|---|---|---|
| V338S | CCTAATTATGCAAAAtcTAAAGGAAGTGATGAAG | 339 | CTTCATCACTTCCTTTAGATTTTGCATAATTAGG | 340 |
| V338T | CCTAATTATGCAAAAacTAAAGGAAGTGATGAAG | 341 | CTTCATCACTTCCTTTAGTTTTTGCATAATTAGG | 342 |
| V338N | CCTAATTATGCAAAAaaTAAAGGAAGTGATGAAG | 343 | CTTCATCACTTCCTTTATTTTTGCATAATTAGG | 344 |
| V338Q | CCTAATTATGCAAAcaaAAAGGAAGTGATGAAG | 345 | CTTCATCACTTCCTTTttGTTTTGCATAATTAGG | 346 |
| V338G | CCTAATTATGCAAAAGgTAAAGGAAGTGATGAAG | 347 | CTTCATCACTTCCTTTACCTTTTGCATAATTAGG | 348 |
| R465V | GAAGCGGAGTATgtAACGTTAAGTGCTAATG | 349 | CATTAGCACTTAACGTTACATACTCCGCTTC | 350 |
| R465L | GAAGCGGAGTATCtAACGTTAAGTGCTAATG | 351 | CATTAGCACTTAACGTTAGATACTCCGCTTC | 352 |
| R465T | GAAGCGGAGTATAcAACGTTAAGTGCTAATG | 353 | CATTAGCACTTAACGTTGTATACTCCGCTTC | 354 |
| R465N | GAAGCGGAGTATAatACGTTAAGTGCTAATG | 355 | CATTAGCACTTAACGTATTATACTCCGCTTC | 356 |
| R465Q | GAAGCGGAGTATCaAACGTTAAGTGCTAATG | 357 | CATTAGCACTTAACGTTTGATACTCCGCTTC | 358 |
| D471V | GTTAAGTGCTAATGtTGATGGAGTGTATATGC | 359 | GCATATACACTCCATCAACATTAGCACTTAAC | 360 |

TABLE 8-continued

Primers useful for residue spin mutations.

| Name | Forward Primer (5'→3') | SEQ ID NO: | Reverse Primer (5'→3') | SEQ ID NO: |
|---|---|---|---|---|
| D471I | GTTAAGTGCTAATatTGATGGAGTGTATATGC | 361 | GCATATACACTCCATCAATATTAGCACTTAAC | 362 |
| D471N | GTTAAGTGCTAATaaTGATGGAGTGTATATGC | 363 | GCATATACACTCCATCATTATTAGCACTTAAC | 364 |
| D471Q | GTTAAGTGCTAATcAaGATGGAGTGTATATGC | 365 | GCATATACACTCCATCTTGATTAGCACTTAAC | 366 |
| D471R | GTTAAGTGCTAATcgTGATGGAGTGTATATGC | 367 | GCATATACACTCCATCACGATTAGCACTTAAC | 368 |
| K455V | GAAATTGACTTAAATAAGgtAAAAGTAGAATCAAGTG | 369 | CACTTGATTCTACTTTTACCTTATTTAAGTCAATTTC | 370 |
| K455I | GAAATTGACTTAAATAAGAtAAAAGTAGAATCAAGTG | 371 | CACTTGATTCTACTTTTATCTTATTTAAGTCAATTTC | 372 |
| K455G | GAAATTGACTTAAATAAGggAAAAGTAGAATCAAGTG | 373 | CACTTGATTCTACTTTTCCCTTATTTAAGTCAATTTC | 374 |
| K455S | GAAATTGACTTAAATAAGtcAAAAGTAGAATCAAGTG | 375 | CACTTGATTCTACTTTTGACTTATTTAAGTCAATTTC | 376 |
| K455N | GAAATTGACTTAAATAAGAAcAAAGTAGAATCAAGTG | 377 | CACTTGATTCTACTTTGTTCTTATTTAAGTCAATTTC | 378 |
| K455E | GAAATTGACTTAAATAAGgAAAAGTAGAATCAAGTG | 379 | CACTTGATTCTACTTTTTCCTTATTTAAGTCAATTTC | 380 |
| F400Q | GATACGGATAAATTAcagTGTCCAGATCAATC | 381 | GATTGATCTGGACACTGTAATTTATCCGTATC | 382 |
| F400S | GATACGGATAAATTAtctTGTCCAGATCAATC | 383 | GATTGATCTGGACAAGATAATTTATCCGTATC | 384 |
| F400M | GATACGGATAAATTAatgTGTCCAGATCAATC | 385 | GATTGATCTGGACACATTAATTTATCCGTATC | 386 |
| F400W | GATACGGATAAATTAtggTGTCCAGATCAATC | 387 | GATTGATCTGGACACCATAATTTATCCGTATC | 388 |
| F400Y | GATACGGATAAATTAtatTGTCCAGATCAATC | 389 | GATTGATCTGGACAATATAATTTATCCGTATC | 390 |
| F400E | GATACGGATAAATTAgagTGTCCAGATCAATC | 391 | GATTGATCTGGACACTCTAATTTATCCGTATC | 392 |
| F400R | GATACGGATAAATTAcgtTGTCCAGATCAATC | 393 | GATTGATCTGGACAACGTAATTTATCCGTATC | 394 |
| N700E | GAAATAAACTTTTCATTgagTTGGGGACAAATGG | 395 | CCATTTGTCCCCAACTCAATGAAAAGTTTATTTC | 396 |
| N700R | GAAATAAACTTTTCATTcgcTTGGGGACAAATGG | 397 | CCATTTGTCCCCAAGCGAATGAAAAGTTTATTTC | 398 |
| N700S | GAAATAAACTTTTCATTagtTTGGGGACAAATGG | 399 | CCATTTGTCCCCAAACTAATGAAAAGTTTATTTC | 400 |
| N700L | GAAATAAACTTTTCATTctcTTGGGGACAAATGG | 401 | CCATTTGTCCCCAAGAGAATGAAAAGTTTATTTC | 402 |
| N700M | GAAATAAACTTTTCATTatgTTGGGGACAAATGG | 403 | CCATTTGTCCCCAACATAATGAAAAGTTTATTTC | 404 |
| N700W | GAAATAAACTTTTCATTtggTTGGGGACAAATGG | 405 | CCATTTGTCCCCAACCAAATGAAAAGTTTATTTC | 406 |
| N700Y | GAAATAAACTTTTCATTtacTTGGGGACAAATGG | 407 | CCATTTGTCCCCAAGTAAATGAAAAGTTTATTTC | 408 |
| N700F | GAAATAAACTTTTCATTttcTTGGGGACAAATGG | 409 | CCATTTGTCCCCAAGAAAATGAAAAGTTTATTTC | 410 |
| V768M | AATACCGGATTATATatgGAACTTTCCCGTCGC | 411 | GCGACGGGAAAGTTCCATATATAATCCGGTATT | 412 |
| V768W | AATACCGGATTATATtggGAACTTTCCCGTCGC | 413 | GCGACGGGAAAGTTCCCAATATAATCCGGTATT | 414 |
| V768Y | AATACCGGATTATATtatGAACTTTCCCGTCGC | 415 | GCGACGGGAAAGTTCATAATATAATCCGGTATT | 416 |
| V768E | AATACCGGATTATATgaaGAACTTTCCCGTCGC | 417 | GCGACGGGAAAGTTCTTCATATATAATCCGGTATT | 418 |
| V768R | AATACCGGATTATATcgaGAACTTTCCCGTCGC | 419 | GCGACGGGAAAGTTCTCGATATAATCCGGTATT | 420 |
| V768Q | AATACCGGATTATATcaaGAACTTTCCCGTCGC | 421 | GCGACGGGAAAGTTCTTGATATAATCCGGTATT | 422 |
| V768T | AATACCGGATTATATACAGAACTTTCCCGTCGC | 423 | GCGACGGGAAAGTTCTGTATATAATCCGGTATT | 424 |
| L494M | GATAAATGGGTTTGGCatgCAAGCTGATGAAAATTC | 425 | GAATTTTCATCAGCTTGCATGCCAAACCCATTTATC | 426 |
| L494W | GATAAATGGGTTTGGCtggCAAGCTGATGAAAATTC | 427 | GAATTTTCATCAGCTTGCCAGCCAAACCCATTTATC | 428 |
| L494Y | GATAAATGGGTTTGGCtacCAAGCTGATGAAAATTC | 429 | GAATTTTCATCAGCTTGGTAGCCAAACCCATTTATC | 430 |
| L494E | GATAAATGGGTTTGGCgagCAAGCTGATGAAAATTC | 431 | GAATTTTCATCAGCTTGCTCGCCAAACCCATTTATC | 432 |
| L494R | GATAAATGGGTTTGGCcgcCAAGCTGATGAAAATTC | 433 | GAATTTTCATCAGCTTGGCGGCCAAACCCATTTATC | 434 |

TABLE 8 -continued

Primers useful for residue spin mutations.

| Name | Forward Primer (5'→3') | SEQ ID NO: | Reverse Primer (5'→3') | SEQ ID NO: |
|---|---|---|---|---|
| L494Q | GATAAATGGGTTTGGCcagCAAGCTGATGAAAATTC | 435 | GAATTTTCATCAGCTTGCTGGCCAAACCCATTTATC | 436 |
| L494T | GATAAATGGGTTTGGCaccCAAGCTGATGAAAATTC | 437 | GAATTTTCATCAGCTTGGGTGCCAAACCCATTTATC | 438 |
| L642E | TTACTACAGGAACTGATgaaAAGGGAGTGTATTT | 439 | AAATACACTCCCTTTTCATCAGTTCCTGTAGTAA | 440 |
| L642M | TTACTACAGGAACTGATatgAAGGGAGTGTATTT | 441 | AAATACACTCCCTTCATATCAGTTCCTGTAGTAA | 442 |
| L642N | TTACTACAGGAACTGATaatAAGGGAGTGTATTT | 443 | AAATACACTCCCTTATTATCAGTTCCTGTAGTAA | 444 |
| L642R | TTACTACAGGAACTGATcgaAAGGGAGTGTATTT | 445 | AAATACACTCCCTTTCGATCAGTTCCTGTAGTAA | 446 |
| L642S | TTACTACAGGAACTGATtcaAAGGGAGTGTATTT | 447 | AAATACACTCCCTTTGAATCAGTTCCTGTAGTAA | 448 |
| L642W | TTACTACAGGAACTGATtggAAGGGAGTGTATTT | 449 | AAATACACTCCCTTCCAATCAGTTCCTGTAGTAA | 450 |
| L642Y | TTACTACAGGAACTGATtatAAGGGAGTGTATTT | 451 | AAATACACTCCCTTATAATCAGTTCCTGTAGTAA | 452 |

Example 5. Bioassay of Residue Spin Mutants

The residue spin Vip3D mutants described in Example 4 were tested against European corn borer (ECB) as described above. Many mutants were tested in two separate bioassays and many of them tested in three separate bioassays. Biological activity was compared to the alanine mutant at that same position. Results from some of these bioassays are shown in Table 9. Spin residues are compared to the alanine mutant results from Example 3.

TABLE 9

Bioactivity of spin residue mutants against European corn borer.

| Residue Spin Mutation | ECB Activity | Residue Spin Mutation | ECB Activity | Residue Spin Mutation | ECB Activity |
|---|---|---|---|---|---|
| V338A | +++ | D471A | +++ | M747A | − |
| V338N | +++ | D471N | +++ | M747W | + |
| V338T | +++ | D471T | +++ | M747Y | − |
| V338P | +++ | D471I | ++ | M747S | − |
| V338G | +++ | D471Q | ++ | M747K | − |
| V338W | + | D471V | + | M747E | − |
| V338Y | + | S532A | − | M747C | − |
| V338S | + | S532N | +++ | M747Q | − |
| V338L | + | S532Y | ++ | L766A | − |
| V338K | + | S532K | +++ | L766T | + |
| V338I | − | S532M | +++ | L766P | ++ |
| V338M | + | S532C | − | L766G | + |
| V338E | ++ | S532D | +++ | L766W | ++ |
| V338C | + | I544A | +++ | L766S | ++ |
| V338Q | ++ | I544N | +++ | L766K | + |
| V338F | ++ | H608A | +++ | L766I | + |
| V338D | ++ | H608L | +++ | L766M | + |
| K455A | +++ | Y629A | − | L766E | ++ |
| K455N | + | Y629W | − | L766C | ++ |
| K455T | ++ | Y629S | − | L766F | ++ |
| K455G | +++ | Y629K | − | L766R | ++ |
| K455I | +++ | Y629E | − | G580A | + |
| K455E | +++ | Y6290 | − | G580N | ++ |
| R465A | − | Y629F | ++ | G580T | ++ |
| R465N | ++ | R635A | +++ | G580P | + |
| V465T | + | R635S | ++ | G580W | +++ |
| V465P | + | K643A | +++ | G580Y | ++ |
| V465G | + | K6435 | +++ | G580S | ++ |
| V465W | ++ | L649A | ++ | G580K | ++ |
| V465Y | + | L649W | − | G580M | ++ |
| V465S | ++ | L649S | − | G580C | ++ |

TABLE 9-continued

Bioactivity of spin residue mutants against European corn borer.

| Residue Spin Mutation | ECB Activity | Residue Spin Mutation | ECB Activity | Residue Spin Mutation | ECB Activity |
|---|---|---|---|---|---|
| V465L | ++ | L649R | − | G580H | ++ |
| V465K | ++ | S683A | − | G580L | ++ |
| V465I | ++ | S683N | − | G580E | +++ |
| V465M | ++ | S683Y | − | K650A | − |
| V465E | ++ | S683K | − | K650N | ++ |
| V465C | ++ | S683M | − | | |
| V465Q | ++ | S683C | − | | |
| V465F | − | S683D | − | | |
| V465D | ++ | | | | |

Example 6. Advanced Testing of Vip3 Mutants

Certain non-limiting criteria may be used to select mutant polypeptides described in the Examples above for further testing and evaluation. Mutants that were advanced had: (1) improved ECB activity; (2) no negative effect on FAW activity; (3) the ability to be expressed in E. coli; and (4) no observed instability.

Based on these critera, 12 single Vip3D mutant polypeptides including V338A, K455A, K455G, R465L, S532D, S532Y, I5444A, G580A, S712A, E760A, L766W and V768A were tested in at least three further bioassays against ECB essentially as described above at a polypeptide concentration of 300 ng/cm$^2$ of diet. Results are shown in Table 10.

TABLE 10

Bioactivity of Vip3 mutants against European corn borer.

| Vip3D Mutant | % Mortality Range |
|---|---|
| V338A | >90 |
| K455A | >90 |
| K455G | 50-90 |
| R465L | 50-90 |
| S532D | 50-90 |
| S532Y | 50-90 |

TABLE 10-continued

Bioactivity of Vip3 mutants against European corn borer.

| Vip3D Mutant | % Mortality Range |
|---|---|
| I544A | >90 |
| G580A | 50-90 |
| S712A | >90 |
| E760A | >90 |
| L766W | 50-90 |
| V768A | >90 |

The six mutants that consistently produced >90% ECB mortality were advanced for determination of the engineered polypeptide's $LC_{50}$ (lethal concentration required to kill 50% of the exposed insects).

Example 7. Determination of LC50s for Selected Engineered Polypeptides

Nucleic acid molecules encoding each mutant polypeptide were cloned into a pTrcHis TOPO® vectors (Invitrogen Corp., Carlsbad, Calif.) according to the manufacturer's instructions. The pTrcHis TOPO® vector has a HisG epitope and a 6xHis tag N-terminal to the mutant coding sequence for detection and purification of the recombinant polypeptide. A pTrcHis-Vip3D mutant vector was transformed into E. coli using essentially the manufacturer's instructions. Each E. coli clone was grown at 37° C., induced using IPTG, cells harvested and lysates prepared as per the manufacturer's instructions. Mutant polypeptides were purified using the ProBond™ Purification System (Invitrogen Corp.), which is designed for purification of 6xHis-tagged recombinant polypeptides expressed in bacteria, essentially according to the manufacturer's instructions. Purified mutant polypeptides were quantitated and used for $LC_{50}$ determinations.

Each mutant polypeptide was tested at multiple concentrations in ECB bioassays essentially as described above. Probit analysis was used to calculate the $LC_{50}$ for each mutant polypeptide. Table 11 shows the $LC_{50}$ values for six mutant polypeptides compared to the wild-type Vip3D, as well as Vip3C (SEQ ID NO: 17) and Vip3A (SEQ ID NO: 15), both of which are members of the Vip3 polypeptide class that are closely related to Vip3D.

TABLE 11

Specific activity of mutant polypeptides against ECB and FAW.

| Insect Species | $LC_{50}$ ($\mu g/cm_2$) of Vip3 wild-type and mutant polypeptides | | | | | | | | |
|---|---|---|---|---|---|---|---|---|---|
| | Vip3A | Vip3C | Vip3D | V338A | K455A | I544A | S712A | E760A | V768A |
| ECB | Inactive | 0.5 | 0.45 | 0.47 | 0.19 | 0.21 | 0.18 | 0.21 | 0.15 |
| FAW | 0.20 | 0.34 | 0.15 | 1.18 | 0.11 | 0.94 | 1.78 | 1.03 | 0.43 |

Results show that five of the selected mutant Vip3D polypeptides have a 2-3 fold lower $LC_{50}$ against European corn borer (ECB) than the wild-type Vip3D, which significantly increases the likelihood they would be high dose in ECB management. One mutant, V338A, has approximately the same $LC_{50}$ against ECB as the wild-type Vip3D polypeptide. Interestingly, most of the mutants had a higher $LC_{50}$ against fall armyworm (FAW) than the wild-type. One mutant, K455A, had a lower LC50 against FAW. Therefore, the K455A mutation improved the specific activity of the parent wild-type Vip3D polypeptide against both ECB and FAW.

Example 8. Characterization of Vip3E

The Vip3D-K455A mutant was analyzed further. Using extracts from lepidopteran insect guts, this particular position, K455, was determined to be a "hot spot" in Vip3A and Vip3D that is recognized by lepidopteran gut enzymes for degradation of the polypeptide. By removing this "hot spot" (i.e. by making a K→A mutation), degradation of a Vip3 polypeptide by serine proteases may be blocked, thereby stabilizing the Vip3 polypeptide in the insect gut and allowing it more time to act (e.g., kill or otherwise control the insect). The Vip3D-K455A mutant was named Vip3E.

Further assays of Vip3E showed that at 3 $\mu g/cm^2$, the polypeptide is: (1) highly active (100% mortality) against European corn borer, fall army worm, black cutworm (*Agrotis ipsilon*), corn earworm (*Helicoverpa zea*), beet armyworm (*Spodoptera exigua*) and diamondback moth (*Plutella xylostella*); (2) moderately active (>50% mortality and significant growth inhibition) against pink bollworm (*Pectinophora gossypiella*), and tobacco budworm (*Heliothis virescens*), causing some mortality, feeding and/or growth inhibition; and (3) not active against monarch butterfly (*Danaus plexippus*), an environmentally beneficial lepidopteran insect, or the coleopteran pests, western corn rootworm (*Diabrotica virgifera*) and Colorado potato beetle (*Leptinotarsa decemlineata*).

Example 9. Expression of Vip3E in Plants

A synthetic maize-optimized polynucleotide (SEQ ID NO:454) encoding the Vip3E polypeptide was transformed into maize plants. For this example, a first expression cassette was made comprising a maize ubiquitin promoter (Ubi1) operably linked to the Vip3E coding sequence which was operably linked to a Nos terminator and a second expression cassette was made comprising a Ubi1 promoter operably linked to a phosphomannose isomerase (PMI) coding sequence which was operably linked to a Nos terminator. Expression of PMI allows for positive selection of transgenic plants on mannose. Both expression cassettes were cloned into a suitable vector for *Agrobacterium*-mediated maize transformation. The resulting vector was designated pSYN12225 (FIG. 1).

Transformation of immature maize embryos was performed essentially as described in Negrotto et al., 2000, *Plant Cell Rep* 19:798-803. Briefly, *Agrobacterium* strain LBA4404 (pSB1) comprising pSYN12225 was grown on YEP (yeast extract (5 g/L), peptone (10 g/L), NaCl (5 g/L), 15 g/l agar, pH 6.8) solid medium for 2-4 days at 28° C. Approximately $0.8 \times 10^9$ *Agrobacterium* cells were suspended in LS-inf media supplemented with 100 µM As. Bacteria were pre-induced in this medium for approximately 30-60 minutes.

Immature embryos from maize inbred JHAX707 were excised from 8-12 day old ears into liquid LS-inf+100 µM As. Embryos were rinsed once with fresh infection medium. *Agrobacterium* solution was then added and embryos were vortexed for 30 seconds and allowed to settle with the bacteria for 5 minutes. The embryos were then transferred scutellum side up to LSAs medium and cultured in the dark for two to three days. Subsequently, between approximately 20 and 25 embryos per petri plate were transferred to LSDc medium supplemented with cefotaxime (250 mg/l) and silver nitrate (1.6 mg/l) and cultured in the dark at approximately 28° C. for 10 days.

Immature embryos, producing embryogenic callus were transferred to LSD1M0.5S medium. The cultures were selected on this medium for approximately 6 weeks with a subculture step at about 3 weeks. Surviving calli were transferred to Reg1 medium supplemented with mannose. Following culturing in the light (16 hour light/8 hour dark regiment), green tissues were then transferred to Reg2 medium without growth regulators and incubated for about 1-2 weeks. Plantlets were transferred to Magenta GA-7 boxes (Magenta Corp, Chicago Ill.) containing Reg3 medium and grown in the light. After about 2-3 weeks, plants were tested for the presence of the PMI genes and the vip3E gene by PCR. Positive plants from the PCR assay were transferred to a greenhouse and tested for resistance to insect pests.

Example 10. Analysis of Transgenic Maize Plants

Plants were sampled as they are being transplanted from Magenta GA-7 boxes into soil. Sampling consisted of cutting two small pieces of leaf (about 2-4 cm long) and placing each in a small petri dish. Vip3E protein concentration was determined on leaves from the same plants. Negative controls were either transgenic plants that were PCR negative for the vip3E gene from the same experiment, or from non-transgenic plants (of a similar size to test plants) that were being grown under similar conditions.

Leaf samples from each plant were inoculated with either European corn borer (*Ostrinia nubilalis*) or fall armyworm (*Spodoptera frugiperda*) by placing 10 first instar larvae onto each leaf piece. Petri dishes were then tightly sealed.

Bioassay data were collected at about 3-4 days post-inoculation. The percent mortality of the larvae was calculated along with a visual damage rating of the leaf. Feeding damage was rated as high, moderate, low, or absent and given a numerical value of 3, 2, 1 or 0, respectively.

Results shown in Table 12 indicate that transgenic maize plants comprising a vip3E polynucleotide and expressing the Vip3E polypeptide, are insecticidal to at least European corn borer (ECB) and fall armyworm (FAW). Some Vip3E-expressing events were also active against black cutworm (*Agrotis ipsilon*) and corn earworm (*Helicoverpa zea*). Vip3E protein concentration in these events ranged from about 450-1000 µg/mg soluble protein.

TABLE 12

Efficacy of transgenic maize expressing Vip3E.

| | Event | | | |
|---|---|---|---|---|
| | ECB % Mortality | ECB Feeding Damage | FAW % Mortality | FAW Feeding Damage |
| 1302A9A | 100 | 0.5 | 100 | 0 |
| 1302A8A | 100 | 1 | 100 | 0 |
| 1301A9A | 95 | 1.5 | 100 | 0 |
| 1301A5A | 100 | 0.5 | 100 | 0 |
| 1301A6A | 100 | 1 | 100 | 0 |
| 1301A2A | 100 | 0 | 100 | 0 |
| 1304A11A | 100 | 0 | 100 | 0 |
| 1304A13A | 100 | 0.5 | 100 | 0 |
| Neg Control | 0 | 3 | 0 | 3 |

Example 11. Improved Engineered Polypeptides can Increase Speed of Kill

Engineered polypeptides of the invention have a variety of functions, uses and activities. For example, the engineered polypeptides of the invention can accelerate the kill rate compared to wild-type polypeptides against a targeted pest organism. In this example, engineered polypeptides and wild-type Vip3D were tested against corn earworm (CEW; *Helicoverpa zea*) at approximately the same polypeptide concentration and the CEW mortality scored after 120 hr.

Results are shown in Table 13. Some engineered polypeptides produced faster kill rates than wild-type Vip3D. For example, mutants S761A, T750A, S683A and T686A caused 58-64% mortality after 120 hr compared to 33% mortality caused by wild-type Vip3D.

TABLE 13

Speed of kill bioassay results.

| Mutant | Percent mortality (120 hr) |
|---|---|
| P681A | 27 |
| S683A | 58 |
| T686A | 58 |
| S691A | 0 |
| L701A | 0 |
| I721A | 8 |
| S722A | 0 |
| S744A | 46 |
| M747A | 42 |
| T750A | 64 |
| T756A | 50 |
| S761A | 58 |
| Vip3D | 33 |
| Negative Control | 0 |

Example 12. Methods as Applied to the Making of Other Recombinant Polypeptides

The above described methods can be used for identifying target amino acid positions for mutation analysis in any polypeptide where 1) one or more family members has moderate to high activity against a target pest; and 2) one or more members of the same family have low to no activity against the same target pest. For example, such methods can be applied to *Bacillus thuringiensis* Cry proteins to improve their insecticidal activity against a certain target pest(s). For example, without limitation, these methods can be applied to the Cry2A class of Bt Cry proteins.

Cry2Aa (SEQ ID NO: 455) and Cry2Ab (SEQ ID NO: 456) are both moderately active against certain *Heliothine* species. However, Cry2Ac (SEQ ID NO: 457), a closely related member of the Cry2A family, has very low specific activity against many of these pests, particularly *Helicoverpa* species.

The relative toxicities (LC$_{50}$ (ng/cm$^2$)) of Cry2A proteins for *Heliothine* species were reported in Liao et al. 2002. J. Invert. Pathol., 80: 55-63 as follows: (1) *Helicoverpa armigera*: Cry2Aa=149, Cry2Ab=421 and Cry2Ac=1678; (2) *Helicoverpa punctigera*: Cry2Aa=52, Cry2Ab=412 and Cry2Ac=6205; (3) *Helicoverpa zea*: Cry2Aa=114-4043, Cry2Ab=61 and Cry2Ac=Not Determined; and (4) *Helicoverpa virescens*: Cry2Aa=15.1, Cry2Ab=20.6 and Cry2Ac=120.

To improve the activity of Cry2Ab against at least certain *Helicoverpa* species, all three amino acid sequences can be aligned as shown in Table 10. Based on the criteria described above, the amino acid positions can be categorized as "essential" (bolded in Table 14), "synergist" (* in Table 14), or "cryptic synergist" (underlined in Table 14) in order to identify the key amino acids to mutate as described above. Such categorization is shown in Table 15. Numbering of the amino acid residues in Table 15 is based on the amino acid sequence of Cry2Ab (SEQ ID NO:45).

TABLE 14

Alignment of Cry 2 amino acid sequences.

Alignment: Global Protein alignment against reference molecule
Parameters: Scoring matrix: BLOSUM 62
Reference molecule: Cry2Aa, Region 1-633
Number of sequences to align: 3

| Pos | Sequence | Start | End | Length | Matches | % Identity |
|-----|----------|-------|-----|--------|---------|------------|
| Ref 1 | Cry2Aa (SEQ ID NO: 457) | 1 | 633 | 633 aa | | |
| 2 | Cry2Ac (SEQ ID NO: 359) | 1 | 622 | 622 aa | 508 | 80 |
| 3 | Cry2Ab (SEQ ID NO: 358) | 1 | 633 | 633 aa | 556 | 87 |

```
                       *                                  *
Cry2Aa    1 MNNVLNSGRTTICDAYNVVAHDPFSFEHKSLDTIQKEWMEWKRTDHSLYV
Cry2Ac    1 MNTVLNNGRNTTCHAHNVVAHDPFSFEHKSLNTIEKEWKEWKRTDHSLYV
Cry2Ab    1 MNSVLNSGRTTICDAYNVAAHDPFSFQHKSLDTVQKEWTEWKKNNHSLYL

*                           *
Cry2Aa   51 APVVGTVSSFLLKKVGSLIGKRILSELWGIIFPSGSTNLMQDILRETEQF
Cry2Ac   51 APIVGTVGSFLLKKVGSLVGKRILSELQNLIFPSGSIDLMQEILRATEQF
Cry2Ab   51 DPIVGTVASFLLKKVGSLVGKRILSELRNLIFPSGSTNLMQDILRETEKF

*         *
Cry2Aa  101 LNQRLNTDTLARVNAELIGLQANIREFNQQVDNFLNPTQNPVPLSITSSV
Cry2Ac  101 INQRLNADTLGRVNAELAGLQANVAEFNRQVDNFLNPNQNPVPLAIIDSV
Cry2Ab  101 LNQRLNTDTLARVNAELTGLQANVEEFNRQVDNFLNPNRNAVPLSITSSV

*
Cry2Aa  151 NTMQQLFLNRLPQFQIQGYQLLLLPLFAQAANMHLSFIRDVILNADEWGI
Cry2Ac  151 NTLQQLFLSRLPQFQIQGYQLLLLPLFAQAANFNLSFIRGVILNADEWGI
Cry2Ab  151 NTMQQLFLNRLPQFQMQGYQLLLLPLFAQAANLHLSFIRDVILNADEWGI

Cry2Aa  201 SAATLRTYRDYLRNYTRDYSNYCINTYQTAFRGLNTRLHDMLEFRTYMFL
Cry2Ac  201 SAATVRTYRDHLRKFHRDYSNYCINPYQTAFRGLNHRLPDMLEFRTYMFL
Cry2Ab  201 SAATLRTYRDYLKNYTRDYSNYCINTYQSAFKGLNTRLHDMLEFRTYMFL

Cry2Aa  251 NVFEYVSIWSLFKYQSLMVSSGANLYASGSGPQQTQSFTAQNWPFLYSLF
Cry2Ac  251 NVFEYVSIWSLFKYQSLLVSSGANLYASGSGP--TQSFTAQNWPFLYSLF
Cry2Ab  251 NVFEYVSIWSLFKYQSLLVSSGANLYASGSGPQQTQSFTSQDWPFLYSLF

*                           *  **       *
Cry2Aa  301 QVNSNYILSGISGTRLSITFPNIGGLPGSTTTHSLNSARVNYSGGVSSGL
Cry2Ac  299 QVNSNYVLNGLSGARTTITFPNIGGLPVYHNS-TLHFARINYRGGVSSSR
Cry2Ab  301 QVNSNYVLNGFSGARLSNTFPNIVGLPGSTTTHALLAARVNYSGGISSGD

*          *   *
Cry2Aa  351 IGATNLNHNFNCSTVLPPLSTPFVRSWLDSGTDREGVATSTNWQTESFQT
Cry2Ac  348 IGQANLNQNFNISTLFNPLQTPFIRSWLDSGTDREGVATSTNWQSGAFET
Cry2Ab  351 IGASPFNQNFNCSTFLPPLLTPFVRSWLDSGSDREGVATVTNWQTESFET

*   *                                       *
Cry2Aa  401 TLSLRCGAFSARGNSNYFPDYFIRNISGVPLVIRNEDLTRPLHYNQIRNI
Cry2Ac  398 TL-LRFSIFSARGNSNFFPDYFIRNISGVVGTISNADLARPLHFNEIRDI
Cry2Ab  401 TLGLRSGAFTARGNSNYFPDYFIRNISGVPLVVRNEDLRRPLHYNEIRNI

*                                *
Cry2Aa  451 ESPSGTPGGARAYLVSVHNRKNNIYAANENGTMIHLAPEDYTGFTISPIH
Cry2Ac  447 ----GTT--AVASLVTVHNRKNNIYDTHENGTMIHLAPNDYTGFTVSPIH
Cry2Ab  451 ASPSGTPGGARAYMVSVHNRKNNIHAVHENGSMIHLAPNDYTGFTISPIH
```

TABLE 14 -continued

Alignment of Cry 2 amino acid sequences.

```
Cry2Aa  501 ATQVNNQTRTFISEKFGNQGDSLRFEQSNTTARYTLRGNGNSYNLYLRVS
Cry2Ac  491 ATQVNNQIRTFISEKYGNQGDSLRFELSNPTARYTLRGNGNSYNLYLRVS
Cry2Ab  501 ATQVNNQTRTFISEKFGNQGDSLRFEQNNTTARYTLRGNGNSYNLYLRVS

Cry2Aa  551 SIGNSTIRVTINGRVYTVSNVNTTTNNDGVNDNGARFSDINIGNIVASDN
Cry2Ac  541 SIGSSTIRVTINGRVYT-ANVNTTTNNDGVLDNGARFSDINIGNVVASAN
Cry2Ab  551 SIGNSTIRVTINGRVYTATNVNTTTNNDGVNDNGARFSDINIGNVVASSN

Cry2Aa  601 TNVTLDINVTLNSGTPFDLMNIMFVPTNLPPLY
Cry2Ac  590 TNVPLDIQVTFNGNPQFELMNIMFVPTNLPPLY
Cry2Ab  601 SDVPLDINVTLNSGTQFDLMNIMLVPTNISPLY
```

TABLE 15

Identified amino acid positions to mutate for engineering Cry2Ab.

Essential

| S7 | T107 | Y215 | A337 | L404 | T456 | V603 |
|---|---|---|---|---|---|---|
| S10 | A111 | T216 | V340 | G413 | V467 | P604 |
| I12 | S145 | T226 | I346 | I426 | L486 | I607 |
| D14 | T147 | T236 | D350 | S427 | P498 | |
| Y16 | S148 | H239 | S363 | G428 | N506 | |
| D32 | M153 | A314 | S363 | P430 | G517 | |
| Q35 | N159 | R315 | T364 | V432 | G520 | |
| T87 | H184 | L326 | T371 | R440 | N544 | |
| N88 | D190 | P327 | N392 | N445 | N570 | |
| D92 | L205 | G328 | W393 | N449 | A597 | |
| E96 | Y211 | S329 | Q394 | A451 | N600 | |
| L101 | N214 | T330 | G403 | P453 | D602 | |

Synergist

| S3 | E125 | A334 | L402 |
|---|---|---|---|
| T39 | L183 | S347 | N435 |
| A58 | N309 | I351 | H468 |
| R78 | T331 | C362 | D589 |
| T118 | H333 | P367 | |

TABLE 15-continued

Identified amino acid positions to mutate for engineering Cry2Ab.

Cryptic Synergist

| A19 | K99 | S290 | E396 | I590 |
|---|---|---|---|---|
| Q27 | V124 | N305 | G407 | N591 |
| V34 | R129 | V307 | V429 | G593 |
| K43 | N138 | S312 | L442 | L605 |
| N44 | R139 | L316 | S454 | S613 |
| N45 | A141 | N322 | S466 | D618 |
| L50 | M166 | S343 | N469 | L619 |
| D51 | K213 | G352 | N472 | |
| I53 | S229 | A353 | E479 | |
| V69 | K232 | P355 | N518 | |
| N79 | L268 | D379 | R558 | |
| L80 | F288 | V387 | V585 | |

It should be understood that the examples and embodiments described herein are for illustrative purposes only and that various modifications or changes in light thereof will be suggested to persons skilled in the art and are to be included within the spirit and purview of this application and the scope of the appended claims.

SEQUENCE LISTING (457 sequences)

SEQ ID NO: 1 - protein, 788 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 2 - DNA, 2367 bp, Bacillus thuringiensis
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 3 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKAKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 4 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagagcgaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 5 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKAKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 6 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggcggggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 7 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYAELSRRSGGGGHISFENVSIK

SEQ ID NO: 8 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgcggaactttcccgtcgctctggtggtggtggtcatatatcatttgaaaacgtttctattaaataa

SEQ ID NO: 9 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSAEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 10 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccgcggaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 11 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTASNNTGLYVELSRRSGGGGHISFENVSIK

SEQ ID NO: 12 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgcgtccaataataccggattatatgtagaactttcccgtcgctctggtggtggtggtcatatatcatttgaaaacgtttctattaaataa

SEQ ID NO: 13 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLALNSYSTYSISFTASGPFNVTVRNSREVLFERSNLMSSTSHISGTFKTESNNTGLYVELSRRSGGGGHISFENVSIK

SEQ ID NO: 14 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtcttgcgttaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 15 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 16 - protein, 787 aa, Bacillus thuringiensis
MNKNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKQDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYMPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNSREVLFEKNYPQLSPKDISEKFTTAANNTGLYVELSRFTSGGAINFRNFSIK

SEQ ID NO: 17 - protein, 788 aa, Bacillus thuringiensis
  MISC_FEATURE (738)..(738): X=G or E
MNKNNTKLSTRALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLAGIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSRXVLFERSNLMSSTSHISGTFKTESNNTGLYVELSRRSGGGGHISFENVSIK

SEQ ID NO: 18 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYATLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 19 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatgcgacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 20 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPAGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 21 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccagcgggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 22 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGAFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 23 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggagcgttttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 24 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGAYVELSRRSGGGGHISFENVSIK

SEQ ID NO: 25 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggagcgtatgtagaactttcccgtcgctctggtggtggtggtcatatatcatttgaaaacgtttctattaaataa

SEQ ID NO: 26 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANADGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 27 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgcggatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 28 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLAADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 29 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctcgcggctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 30 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSALITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 31 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcagcgttaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 32 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGAIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 33 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacggggcgatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 34 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKAKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 35 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaagcgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 36 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKASIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 37 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaagcgtctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 38 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIALKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 39 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattgcgttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 40 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGAIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 41 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggagcgattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 42 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYAHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 43 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatgcgcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 44 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIAYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 45 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattgcgtatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 46 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKAFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 47 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaagcgtttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 48 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLAGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 49 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttagcgggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 50 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAAGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 51 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagctgcgggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 52 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINANSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 53 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatgcgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 54 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHASGTFKTESNNTGLYVELSRRSGGGGHISFENVSIK

SEQ ID NO: 55 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatgcgtctgggacattcaaaactgaatccaataataccggattatatgtagaactttcccgtcgctctggtggtggtggtcatatatcatttgaaaacgtttctattaaataa

SEQ ID NO: 56 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRAGGGGHISFENVSIK

SEQ ID NO: 57 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgcgcgggtggtggtggtcatatatcatttgaaaacgtttctattaaataa

SEQ ID NO: 58 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSAGGGHISFENVSIK

SEQ ID NO: 59 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctgcgggtggtggtcatatatcatttgaaaacgtttctattaaataa

SEQ ID NO: 60 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGAISFENVSIK

SEQ ID NO: 61 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtgcgatatcatttgaaaacgtttctattaaataa

SEQ ID NO: 62 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLREALLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 63 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaagcgctgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 64 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEADNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 65 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagcggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 66 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENAGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 67 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatgcgggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 68 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFAASGPFNVTVRNSREVLFERSNLMSSTSHISGTFKTESNNTGLYVELSRRSGGGGHISFENVSIK

SEQ ID NO: 69 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttgcggcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 70 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFEASNLMSSTSHISGTFKTESNNTGLYVELSRRSGGGGHISFENVSIK

SEQ ID NO: 71 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaagcgagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 72 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERANLMSSTSHISGTFKTESNNTGLYVELSRRSGGGGHISFENVSIK

SEQ ID NO: 73 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgagcgaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 74 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGAFKTESNNTGLYVELSRRSGGGGHISFENVSIK

SEQ ID NO: 75 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctggggcgttcaaaactgaatccaataataccggattatatgtagaactttcccgtcgctctggtggtggtggtcatatatcatttgaaaacgtttctattaaataa

SEQ ID NO: 76 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTEANNTGLYVELSRRSGGGGHISFENVSIK

SEQ ID NO: 77 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaagcgaataataccggattatatgtagaactttcccgtcgctctggtggtggtggtcatatatcatttgaaaacgtttctattaaataa

SEQ ID NO: 78 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNAGLYVELSRRSGGGGHISFENVSIK

SEQ ID NO: 79 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataatgcgggattatatgtagaactttcccgtcgctctggtggtggtggtcatatatcatttgaaaacgtttctattaaataa

SEQ ID NO: 80 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGAHISFENVSIK

SEQ ID NO: 81 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtgcgcatatatcatttgaaaacgtttctattaaataa

SEQ ID NO: 82 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENASIK

SEQ ID NO: 83 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgcgtctattaaataa

SEQ ID NO: 84 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEASNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 85 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaagcgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 86 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGAQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 87 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcgcgcaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 88 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLATLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 89 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattagcgactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 90 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYAVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 91 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatgcggttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 92 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNALKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 93 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataatgcgttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 94 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDAQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 95 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagatgcgcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 96 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILASQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 97 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttagcgagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 98 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPASWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 99 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccggcgtcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 100 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNAWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 101 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaatgcgtggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 102 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINAGTNGTFRQSLSLNSYSTYSISFTASGPFNVTVRNSREVLFERSNLMSSTSHISGTFKTESNNTGLYVELSRRSGGGGHISFENVSIK

SEQ ID NO: 103 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacgcggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 104 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLASSTSHISGTFKTESNNTGLYVELSRRSGGGGHISFENVSIK

SEQ ID NO: 105 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttgcgtcttcaactagtcatatttctgggacattcaaaactgaatccaataataccggattatatgtagaactttcccgtcgctctggtggtggtggtcatatatcatttgaaaacgtttctattaaataa

SEQ ID NO: 106 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRASGGGGHISFENVSIK

SEQ ID NO: 107 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtgcgtctggtggtggtggtcatatatcatttgaaaacgtttctattaaataa

SEQ ID NO: 108 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKAYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 109 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagcgtatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 110 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPAASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 111 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccagcggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 112 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLACPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 113 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattagcgtgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 114 - protein, 11 aa, Bacillus thuringiensis
IYGFATGIKDI

SEQ ID NO: 115 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSAEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLALNSYSTYSISFTASGPFNVTVRNSREVLFERSNLMSSTSHISGTFKTESNNTGLYVELSRRSGGGGHISFENVSIK

SEQ ID NO: 116 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccgcggaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtcttgcgttaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 117 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKAKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKAKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 118 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagcgaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataaggcgaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 119 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIAYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSASHISGTFKTESNNTGLYVELSRRSGGGGHISFENVSIK

SEQ ID NO: 120 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattgcgtatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcagcgagtcatatttctgggacattcaaaactgaatccaataataccggattatatgtagaactttcccgtcgctctggtggtggtggtcatatatcatttgaaaacgtttctattaaataa

SEQ ID NO: 121 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINAGTNGTFRQSLSLNSYSTYSASFTASGPFNVTVRNSREVLFERSNLMSSTSHISGTFKTESNNTGLYVELSRRSGGGGHISFENVSIK

SEQ ID NO: 122 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacgcggggacaaatgggacctttagacaaagtctttcattaaacagttattcaacttatagtgcgagctttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatatcatttgaaaacgtttctattaaataa

SEQ ID NO: 123 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSIAFTASGPFNVTVRNSREVLFERSNLMSSTSHISGTFKTESNNTGLYVELSRRSGGGGHIAFENVSIK

SEQ ID NO: 124 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtatagcgtttactgcatcaggaccatttaatgtgacggtaagaaattctagggaagtattatttgaacgaagcaaccttatgtcttcaactagtcatatttctgggacattcaaaactgaatccaataataccggattatatgtagaactttcccgtcgctctggtggtggtggtcatatagcgtttgaaaacgtttctattaaataa

SEQ ID NO: 125 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERANLMSSTSHISGTFKTEANNTGLYVELSRRSGGGGHISFENVSIK

SEQ ID NO: 126 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgagcgaaccttatgtcttcaactagtcatatttctgggacattcaaaactgaagcgaataataccggattatatgtagaactttcccgtcgctctggtggtggtggtcatatatcatttgaaaacgtttctattaaataa

SEQ ID NO: 127 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERANLMSSTSHISGTFKTESNNTGLYVELSRRSGGGGHIAFENVSIK

SEQ ID NO: 128 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgagcgaaccttatgtcttcaactagtcatatttctgggacattcaaaactgaatccaataataccggattatatgtagaactttcccgtcgctctggtggtggtggtcatatagcgtttgaaaacgtttctattaaataa

SEQ ID NO: 129 - protein, 788 aa, Artificial Sequence
  Mutant Vip3D polypeptide sequence
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSASHISGTFKTESNNTGLYVELSRRSGGGGHIAFENVSIK

SEQ ID NO: 130 - DNA, 2367 bp, Artificial Sequence
  Mutant Vip3D polypeptide coding sequence
atgaatatgaataatactaaattaaacgcaagggccctaccgagttttattgattattttaatggcatttatggatttgccactggtatcaaagacattatgaatatgatttttaaaacggatacaggtggtaatctaaccttagacgaaatcctaaagaatcagcagttactaaatgagatttctggtaaattggatggggtaaatgggagcttaaatgatcttatcgcacagggaaacttaaatacagaattatctaaggaaatcttaaaaattgcaaatgaacagaatcaagtcttaaatgatgttaataacaaactcgatgcgataaatacgatgcttcatatatatctacctaaaattacatctatgttaagtgatgtaatgaagcaaaattatgcgctaagtctgcaaatagaatacttaagtaagcaattgcaagaaatttctgataaattagatattattaacgtaaatgttcttattaactctacacttactgaaattacacctgcatatcaacggattaaatatgtgaatgaaaaatttgaagaattaacttttgctacagaaaccactttaaaagtaaaaaaggatagctcgcctgctgatattcttgatgagttaactgaattaactgaactagcgaaaagtgttacaaaaaatgacgttgatggttttgaattttaccttaatacattccacgatgtaatggtaggaaataatttattcgggcgttcagctttaaaaactgcttcagaattaattgctaaagaaaatgtgaaaacaagtggcagtgaagtaggaaatgtttataatttcttaattgtattaacagctctacaagcaaaagcttttcttactttaacaacatgccgaaaattattaggcttagcagatattgattatacttctattatgaatgaacatttaaataaggaaaaagaggaatttagagtaaacatccttcctacactttctaatactttttctaatcctaattatgcaaaagttaaaggaagtgatgaagatgcaaagatgattgtggaagctaaaccaggacatgcattggttgggtttgaaatgagcaatgattcaatcacagtattaaaagtatatgaggctaagctaaaacaaaattatcaagttgataaggattccttatcggaggttatttatggtgatacggataaattattttgtccagatcaatctgaacaaatatattatacaaataacatagtattcccaaatgaatatgtaattactaaaattgatttcactaaaaaaatgaaaactttaagatatgaggtaacagcgaatttttatgattcttctacaggagaaattgacttaaataagaaaaaagtagaatcaagtgaagcggagtatagaacgttaagtgctaatgatgatggagtgtatatgccattaggtgtcatcagtgaaacatttttgactccgataaatgggtttggcctccaagctgatgaaaattcaagattaattactttaacatgtaaatcatatttaagagaactactgctagcaacagacttaagcaataaagaaactaaattgatcgtcccaccaagtggttttattagcaatattgtagagaacgggtccatagaagaggacaatttagagccgtggaaagcaaataataagaatgcgtatgtagatcatacaggcggagtgaatggaactaaagctttatatgttcataaggacggaggattttcacaatttattggagataagttaaaaccgaaaactgagtatgtaatccaatatactgttaaaggaaaaccttctattcatttaaaagatgaaaatactggatatattcattatgaagatacaaataataatttaaaagattatcaaactattactaaacgttttactacaggaactgatttaaagggagtgtatttaattttaaaaagtcaaaatggagatgaagcttggggagataaatttacaattttagaaattaagcctgcggaggatttattaagcccagaattaattaatccgaattcttggattacgactccaggggctagcatttcaggaaataaacttttcattaacttggggacaaatgggacctttagacaaagtctttcattaaacagttattcaacttatagtataagctttactgcatcaggaccatttaatgtgacggtaagaaattctagggaagtattatttgaacgaagcaaccttatgtcttcagcgagtcatatttctgggacattcaaaactgaatccaataataccggattatatgtagaactttcccgtcgctctggtggtggtggtcatatagcgtttgaaaacgtttctattaaataa

SEQ ID NO: 131 - DNA, 33 bp, Artificial Sequence
  Mutagenesis primer
tacaattttagaaattgcgcctgcggaggattt

SEQ ID NO: 132 - DNA, 33 bp, Artificial Sequence
  Mutagenesis primer
aaatcctccgcaggcgcaatttctaaaattgta

SEQ ID NO: 133 - DNA, 33 bp, Artificial Sequence
  Mutagenesis primer
ccagaattaattaatgcgaattcttggattacg

SEQ ID NO: 134 - DNA, 33 bp, Artificial Sequence
  Mutagenesis primer
cgtaatccaagaattcgcattaattaattctgg

SEQ ID NO: 135 - DNA, 28 bp, Artificial Sequence
  Mutagenesis primer
taattaatccgaatgcgtggattacgac

SEQ ID NO: 136 - DNA, 28 bp, Artificial Sequence
  Mutagenesis primer
gtcgtaatccacgcattcggattaatta

SEQ ID NO: 137 - DNA, 27 bp, Artificial Sequence
  Mutagenesis primer
gaattcttggattgcgactccaggggc

SEQ ID NO: 138 - DNA, 27 bp, Artificial Sequence
  Mutagenesis primer
gcccctggagtcgcaatccaagaattc

SEQ ID NO: 139 - DNA, 31 bp, Artificial Sequence
  Mutagenesis primer
cttggattacgactgcgggggctagcatttc

SEQ ID NO: 140 - DNA, 31 bp, Artificial Sequence
  Mutagenesis primer
gaaatgctagcccccgcagtcgtaatccaag

SEQ ID NO: 141 - DNA, 32 bp, Artificial Sequence
  Mutagenesis primer
gactccaggggctgcgatttcaggaaataaac

SEQ ID NO: 142 - DNA, 32 bp, Artificial Sequence
  Mutagenesis primer
gtttatttcctgaaatcgcagcccctggagtc

SEQ ID NO: 143 - DNA, 29 bp, Artificial Sequence
  Mutagenesis primer
gcatttcaggaaatgcgcttttcattaac

SEQ ID NO: 144 - DNA, 29 bp, Artificial Sequence
  Mutagenesis primer
gttaatgaaaagcgcatttcctgaaatgc

SEQ ID NO: 145 - DNA, 39 bp, Artificial Sequence
  Mutagenesis primer
ggaaataaacttttcattaacgcggggacaaatgggacc

SEQ ID NO: 146 - DNA, 39 bp, Artificial Sequence
  Mutagenesis primer
ggtcccatttgtccccgcgttaatgaaaagtttatttcc

SEQ ID NO: 147 - DNA, 35 bp, Artificial Sequence
  Mutagenesis primer
cttttcattaacttgggggcgaatgggacctttag

SEQ ID NO: 148 - DNA, 35 bp, Artificial Sequence
  Mutagenesis primer
ctaaaggtcccattcgcccccaagttaatgaaaag

SEQ ID NO: 149 - DNA, 46 bp, Artificial Sequence
  Mutagenesis primer
ggacctttagacaaagtctttcattagcgagttattcaacttatag

SEQ ID NO: 150 - DNA, 46 bp, Artificial Sequence
  Mutagenesis primer
ctataagttgaataactcgctaatgaaagactttgtctaaaggtcc

SEQ ID NO: 151 - DNA, 28 bp, Artificial Sequence
  Mutagenesis primer
caacttatagtgcgagctttactgcatc

SEQ ID NO: 152 - DNA, 28 bp, Artificial Sequence
  Mutagenesis primer
gatgcagtaaagctcgcactataagttg

SEQ ID NO: 153 - DNA, 40 bp, Artificial Sequence
  Mutagenesis primer
gttattcaacttatagtatagcgtttactgcatcaggacc

SEQ ID NO: 154 - DNA, 40 bp, Artificial Sequence
  Mutagenesis primer
ggtcctgatgcagtaaacgctatactataagttgaataac

SEQ ID NO: 155 - DNA, 41 bp, Artificial Sequence
  Mutagenesis primer
cttatagtataagctttgcggcatcaggaccatttaatgtg

SEQ ID NO: 156 - DNA, 41 bp, Artificial Sequence
  Mutagenesis primer
cacattaaatggtcctgatgccgcaaagcttatactataag

SEQ ID NO: 157 - DNA, 37 bp, Artificial Sequence
  Mutagenesis primer
gctttactgcatcaggagcgtttaatgtgacggtaag

SEQ ID NO: 158 - DNA, 37 bp, Artificial Sequence
  Mutagenesis primer
cttaccgtcacattaaacgctcctgatgcagtaaagc

SEQ ID NO: 159 - DNA, 32 bp, Artificial Sequence
  Mutagenesis primer
gtattatttgaacgagcgaaccttatgtcttc

SEQ ID NO: 160 - DNA, 32 bp, Artificial Sequence
  Mutagenesis primer
gaagacataaggttcgctcgttcaaataatac

SEQ ID NO: 161 - DNA, 31 bp, Artificial Sequence
  Mutagenesis primer
gaacgaagcaacgcgatgtcttcaactagtc

SEQ ID NO: 162 - DNA, 31 bp, Artificial Sequence
  Mutagenesis primer
gactagttgaagacatcgcgttgcttcgttc

SEQ ID NO: 163 - DNA, 38 bp, Artificial Sequence
  Mutagenesis primer
gaacgaagcaaccttgcgtcttcaactagtcatatttc

SEQ ID NO: 164 - DNA, 38 bp, Artificial Sequence
  Mutagenesis primer
gaaatatgactagttgaagacgcaaggttgcttcgttc

SEQ ID NO: 165 - DNA, 38 bp, Artificial Sequence
  Mutagenesis primer
gaacgaagcaaccttatggcgtcaactagtcatatttc

SEQ ID NO: 166 - DNA, 38 bp, Artificial Sequence
  Mutagenesis primer
gaaatatgactagttgacgccataaggttgcttcgttc

SEQ ID NO: 167 - DNA, 29 bp, Artificial Sequence
  Mutagenesis primer
ccttatgtcttcagcgagtcatatttctg

SEQ ID NO: 168 - DNA, 29 bp, Artificial Sequence
  Mutagenesis primer
cagaaatatgactcgctgaagacataagg

SEQ ID NO: 169 - DNA, 35 bp, Artificial Sequence
  Mutagenesis primer
ctagtcatatttctggggcgttcaaaactgaatcc

SEQ ID NO: 170 - DNA, 35 bp, Artificial Sequence
  Mutagenesis primer
ggattcagttttgaacgccccagaaatatgactag

SEQ ID NO: 171 - DNA, 31 bp, Artificial Sequence
  Mutagenesis primer
ggacattcaaaactgcgtccaataataccgg

SEQ ID NO: 172 - DNA, 31 bp, Artificial Sequence
  Mutagenesis primer
ccggtattattggacgcagttttgaatgtcc

SEQ ID NO: 173 - DNA, 36 bp, Artificial Sequence
  Mutagenesis primer
cattcaaaactgaagcgaataataccggattatatg

SEQ ID NO: 174 - DNA, 36 bp, Artificial Sequence
  Mutagenesis primer
catataatccggtattattcgcttcagttttgaatg

SEQ ID NO: 175 - DNA, 32 bp, Artificial Sequence
  Mutagenesis primer
gtagaactttcccgtgcgtctggtggtggtgg

SEQ ID NO: 176 - DNA, 32 bp, Artificial Sequence
  Mutagenesis primer
ccaccaccaccagacgcacgggaaagttctac

SEQ ID NO: 177 - DNA, 28 bp, Artificial Sequence
  Mutagenesis primer
ctttcccgtcgcgcgggtggtggtggtc

SEQ ID NO: 178 - DNA, 28 bp, Artificial Sequence
  Mutagenesis primer
gaccaccaccacccgcgcgacgggaaag

SEQ ID NO: 179 - DNA, 38 bp, Artificial Sequence
  Mutagenesis primer
gaactttcccgtcgctctgcgggtggtggtcatatatc

SEQ ID NO: 180 - DNA, 38 bp, Artificial Sequence
  Mutagenesis primer
gatatatgaccaccacccgcagagcgacgggaaagttc

SEQ ID NO: 181 - DNA, 30 bp, Artificial Sequence
  Mutagenesis primer
ggtggtggtggtgcgatatcatttgaaaac

SEQ ID NO: 182 - DNA, 30 bp, Artificial Sequence
  Mutagenesis primer
gttttcaaatgatatcgcaccaccaccacc

SEQ ID NO: 183 - DNA, 32 bp, Artificial Sequence
  Mutagenesis primer
ggtggtggtcatatagcgtttgaaaacgtttc

SEQ ID NO: 184 - DNA, 32 bp, Artificial Sequence
  Mutagenesis primer
gaaacgttttcaaacgctatatgaccaccacc

SEQ ID NO: 185 - DNA, 33 bp, Artificial Sequence
  Mutagenesis primer
ggtcatatatcatttgcgaacgtttctattaaa

SEQ ID NO: 186 - DNA, 33 bp, Artificial Sequence
  Mutagenesis primer
tttaatagaaacgttcgcaaatgatatatgacc

SEQ ID NO: 187 - DNA, 32 bp, Artificial Sequence
  Mutagenesis primer
ctgcttcagaattaattgcgaaagaaaatgtg

SEQ ID NO: 188 - DNA, 32 bp, Artificial Sequence
  Mutagenesis primer
cacattttctttcgcaattaattctgaagcag

SEQ ID NO: 189 - DNA, 37 bp, Artificial Sequence
  Mutagenesis primer
cattggttgggtttgaagcgagcaatgattcaatcac

SEQ ID NO: 190 - DNA, 37 bp, Artificial Sequence
  Mutagenesis primer
gtgattgaatcattgctcgcttcaaacccaaccaatg

SEQ ID NO: 191 - DNA, 35 bp, Artificial Sequence
  Mutagenesis primer
gattatcaaactattgcgaaacgttttactacagg

SEQ ID NO: 192 - DNA, 35 bp, Artificial Sequence
  Mutagenesis primer
cctgtagtaaaacgtttcgcaatagtttgataatc

SEQ ID NO: 193 - DNA, 37 bp, Artificial Sequence
  Mutagenesis primer
cttggggagataaatttgcgattttagaaattaagcc

SEQ ID NO: 194 - DNA, 37 bp, Artificial Sequence
  Mutagenesis primer
ggcttaatttctaaaatcgcaaatttatctccccaag

SEQ ID NO: 195 - DNA, 38 bp, Artificial Sequence
  Mutagenesis primer
ggaaataaacttttcattgcgttggggacaaatgggac

SEQ ID NO: 196 - DNA, 38 bp, Artificial Sequence
  Mutagenesis primer
gtcccatttgtccccaacgcaatgaaaagtttatttcc

SEQ ID NO: 197 - DNA, 36 bp, Artificial Sequence
  Mutagenesis primer
cttggggacaaatggggcgtttagacaaagtctttc

SEQ ID NO: 198 - DNA, 36 bp, Artificial Sequence
  Mutagenesis primer
gaaagactttgtctaaacgccccatttgtccccaag

SEQ ID NO: 199 - DNA, 37 bp, Artificial Sequence
  Mutagenesis primer
cctttagacaaagtcttgcgttaaacagttattcaac

SEQ ID NO: 200 - DNA, 37 bp, Artificial Sequence
  Mutagenesis primer
gttgaataactgtttaacgcaagactttgtctaaagg

SEQ ID NO: 201 - DNA, 38 bp, Artificial Sequence
  Mutagenesis primer
gtctttcattaaacagtgcgtcaacttatagtataagc

SEQ ID NO: 202 - DNA, 38 bp, Artificial Sequence
  Mutagenesis primer
gcttatactataagttgacgcactgtttaatgaaagac

SEQ ID NO: 203 - DNA, 36 bp, Artificial Sequence
  Mutagenesis primer
cagttattcaacttatgcgataagctttactgcatc

SEQ ID NO: 204 - DNA, 36 bp, Artificial Sequence
  Mutagenesis primer
gatgcagtaaagcttatcgcataagttgaataactg

SEQ ID NO: 205 - DNA, 33 bp, Artificial Sequence
  Mutagenesis primer
ggaccatttaatgtggcggtaagaaattctagg

SEQ ID NO: 206 - DNA, 33 bp, Artificial Sequence
  Mutagenesis primer
cctagaatttcttaccgccacattaaatggtcc

SEQ ID NO: 207 - DNA, 37 bp, Artificial Sequence
  Mutagenesis primer
gaagcaaccttatgtctgcgactagtcatatttctgg

SEQ ID NO: 208 - DNA, 37 bp, Artificial Sequence
  Mutagenesis primer
ccagaaatatgactagtcgcagacataaggttgcttc

SEQ ID NO: 209 - DNA, 38 bp, Artificial Sequence
  Mutagenesis primer
caaaactgaatccaataatgcgggattatatgtagaac

SEQ ID NO: 210 - DNA, 38 bp, Artificial Sequence
  Mutagenesis primer
gttctacatataatcccgcattattggattcagttttg

SEQ ID NO: 211 - DNA, 37 bp, Artificial Sequence
  Mutagenesis primer
ctgaatccaataataccgcgttatatgtagaactttc

SEQ ID NO: 212 - DNA, 37 bp, Artificial Sequence
  Mutagenesis primer
gaaagttctacatataacgcggtattattggattcag

SEQ ID NO: 213 - DNA, 42 bp, Artificial Sequence
  Mutagenesis primer
ctttaaaagtaaaaaaggatgcgtcgcctgctgatattcttg

SEQ ID NO: 214 - DNA, 42 bp, Artificial Sequence
  Mutagenesis primer
caagaatatcagcaggcgacgcatccttttttacttttaaag

SEQ ID NO: 215 - DNA, 34 bp, Artificial Sequence
  Mutagenesis primer
cagctctacaagcagcggcttttcttactttaac

SEQ ID NO: 216 - DNA, 34 bp, Artificial Sequence
  Mutagenesis primer
gttaaagtaagaaaagccgctgcttgtagagctg

SEQ ID NO: 217 - DNA, 33 bp, Artificial Sequence
  Mutagenesis primer
ccaggacatgcattggcggggtttgaaatgagc

SEQ ID NO: 218 - DNA, 33 bp, Artificial Sequence
  Mutagenesis primer
gctcatttcaaaccccgccaatgcatgtcctgg

SEQ ID NO: 219 - DNA, 34 bp, Artificial Sequence
  Mutagenesis primer
cataaggacggaggagcgtcacaatttattggag

SEQ ID NO: 220 - DNA, 34 bp, Artificial Sequence
  Mutagenesis primer
ctccaataaattgtgacgctcctccgtccttatg

SEQ ID NO: 221 - DNA, 34 bp, Artificial Sequence
  Mutagenesis primer
gaaattaagcctgcggaggcgttattaagcccag

SEQ ID NO: 222 - DNA, 34 bp, Artificial Sequence
  Mutagenesis primer
ctgggcttaataacgcctccgcaggcttaatttc

SEQ ID NO: 223 - DNA, 31 bp, Artificial Sequence
  Mutagenesis primer
ggattacgactccagcggctagcatttcagg

SEQ ID NO: 224 - DNA, 31 bp, Artificial Sequence
  Mutagenesis primer
cctgaaatgctagccgctggagtcgtaatcc

SEQ ID NO: 225 - DNA, 38 bp, Artificial Sequence
  Mutagenesis primer
caggaaataaacttgcgattaacttggggacaaatggg

SEQ ID NO: 226 - DNA, 38 bp, Artificial Sequence
  Mutagenesis primer
cccatttgtccccaagttaatcgcaagtttatttcctg

SEQ ID NO: 227 - DNA, 36 bp, Artificial Sequence
  Mutagenesis primer
cattaacttggggacagcggggacctttagacaaag

SEQ ID NO: 228 - DNA, 36 bp, Artificial Sequence
  Mutagenesis primer
ctttgtctaaaggtccccgctgtccccaagttaatg

SEQ ID NO: 229 - DNA, 32 bp, Artificial Sequence
  Mutagenesis primer
gggacaaatgggaccgcgagacaaagtctttc

SEQ ID NO: 230 - DNA, 32 bp, Artificial Sequence
  Mutagenesis primer
gaaagactttgtctcgcggtcccatttgtccc

SEQ ID NO: 231 - DNA, 37 bp, Artificial Sequence
  Mutagenesis primer
gacaaatgggacctttgcgcaaagtctttcattaaac

SEQ ID NO: 232 - DNA, 37 bp, Artificial Sequence
  Mutagenesis primer
gtttaatgaaagactttgcgcaaaggtcccatttgtc

SEQ ID NO: 233 - DNA, 37 bp, Artificial Sequence
  Mutagenesis primer
ggaccatttaatgtgacggcgagaaattctagggaag

SEQ ID NO: 234 - DNA, 37 bp, Artificial Sequence
  Mutagenesis primer
cttccctagaatttctcgccgtcacattaaatggtcc

SEQ ID NO: 235 - DNA, 38 bp, Artificial Sequence
  Mutagenesis primer
gtcttcaactagtcatgcgtctgggacattcaaaactg

SEQ ID NO: 236 - DNA, 38 bp, Artificial Sequence
  Mutagenesis primer
cagttttgaatgtcccagacgcatgactagttgaagac

SEQ ID NO: 237 - DNA, 41 bp, Artificial Sequence
  Mutagenesis primer
gacattcaaaactgaatccgcgaataccggattatatgtag

SEQ ID NO: 238 - DNA, 41 bp, Artificial Sequence
  Mutagenesis primer
ctacatataatccggtattcgcggattcagttttgaatgtc

SEQ ID NO: 239 - DNA, 42 bp, Artificial Sequence
  Mutagenesis primer
cattcaaaactgaatccaatgcgaccggattatatgtagaac

SEQ ID NO: 240 - DNA, 42 bp, Artificial Sequence
  Mutagenesis primer
gttctacatataatccggtcgcattggattcagttttgaatg

SEQ ID NO: 241 - DNA, 38 bp, Artificial Sequence
  Mutagenesis primer
gaatccaataataccggagcgtatgtagaactttcccg

SEQ ID NO: 242 - DNA, 38 bp, Artificial Sequence
  Mutagenesis primer
cgggaaagttctacatacgctccggtattattggattc

SEQ ID NO: 243 - DNA, 41 bp, Artificial Sequence
  Mutagenesis primer
caataataccggattatatgcggaactttcccgtcgctctg

SEQ ID NO: 244 - DNA, 41 bp, Artificial Sequence
  Mutagenesis primer
cagagcgacgggaaagttccgcatataatccggtattattg

SEQ ID NO: 245 - DNA, 31 bp, Artificial Sequence
  Mutagenesis primer
gtagaactttccgcgcgctctggtggtggtg

SEQ ID NO: 246 - DNA, 31 bp, Artificial Sequence
  Mutagenesis primer
caccaccaccagagcgcgcggaaagttctac

SEQ ID NO: 247 - DNA, 31 bp, Artificial Sequence
  Mutagenesis primer
cgctctggtggtggtgcgcatatatcatttg

SEQ ID NO: 248 - DNA, 31 bp, Artificial Sequence
  Mutagenesis primer
caaatgatatatgcgcaccaccaccagagcg

SEQ ID NO: 249 - DNA, 35 bp, Artificial Sequence
  Mutagenesis primer
ggtggtggtggtcatgcgtcatttgaaaacgtttc

SEQ ID NO: 250 - DNA, 35 bp, Artificial Sequence
  Mutagenesis primer
gaaacgttttcaaatgacgcatgaccaccaccacc

SEQ ID NO: 251 - DNA, 40 bp, Artificial Sequence
  Mutagenesis primer
gtcatatatcatttgaagcggtttctattaaataaaaggg

SEQ ID NO: 252 - DNA, 40 bp, Artificial Sequence
  Mutagenesis primer
cccttttatttaatagaaaccgcttcaaatgatatatgac

SEQ ID NO: 253 - DNA, 36 bp, Artificial Sequence
  Mutagenesis primer
catatatcatttgaaaacgcttctattaaataaaag

SEQ ID NO: 254 - DNA, 36 bp, Artificial Sequence
  Mutagenesis primer
cttttatttaatagaagcgttttcaaatgatatatg

SEQ ID NO: 255 - DNA, 33 bp, Artificial Sequence
  Mutagenesis primer
tcccgtcgctctggtgctggtggtcatatatca

SEQ ID NO: 256 - DNA, 33 bp, Artificial Sequence
  Mutagenesis primer
tgatatatgaccaccagcaccagagcgacggga

SEQ ID NO: 257 - DNA, 33 bp, Artificial Sequence
  Mutagenesis primer
atttctgggacattcgcaactgaatccaataat

SEQ ID NO: 258 - DNA, 33 bp, Artificial Sequence
  Mutagenesis primer
attattggattcagttgcgaatgtcccagaaat

SEQ ID NO: 259 - DNA, 32 bp, Artificial Sequence
  Mutagenesis primer
cttatgtcttcaactgctcatatttctgggac

SEQ ID NO: 260 - DNA, 32 bp, Artificial Sequence
  Mutagenesis primer
gtcccagaaatatgagcagttgaagacataag

SEQ ID NO: 261 - DNA, 32 bp, Artificial Sequence
  Mutagenesis primer
ttatttgaacgaagcgcccttatgtcttcaac

SEQ ID NO: 262 - DNA, 32 bp, Artificial Sequence
  Mutagenesis primer
gttgaagacataagggcgcttcgttcaaataa

SEQ ID NO: 263 - DNA, 32 bp, Artificial Sequence
  Mutagenesis primer
gaagtattatttgaagcaagcaaccttatgtc

SEQ ID NO: 264 - DNA, 32 bp, Artificial Sequence
  Mutagenesis primer
gacataaggttgcttgcttcaaataatacttc

SEQ ID NO: 265 - DNA, 31 bp, Artificial Sequence
  Mutagenesis primer
ctgcatcaggaccagctaatgtgacggtaag

SEQ ID NO: 266 - DNA, 31 bp, Artificial Sequence
  Mutagenesis primer
cttaccgtcacattagctggtcctgatgcag

SEQ ID NO: 267 - DNA, 33 bp, Artificial Sequence
  Mutagenesis primer
gtataagctttactgcagcaggaccatttaatg

SEQ ID NO: 268 - DNA, 33 bp, Artificial Sequence
  Mutagenesis primer
cattaaatggtcctgctgcagtaaagcttatac

SEQ ID NO: 269 - DNA, 33 bp, Artificial Sequence
  Mutagenesis primer
cttttcattaacttggcgacaaatgggaccttt

SEQ ID NO: 270 - DNA, 33 bp, Artificial Sequence
  Mutagenesis primer
aaaggtcccatttgtcgccaagttaatgaaaag

SEQ ID NO: 271 - DNA, 31 bp, Artificial Sequence
  Mutagenesis primer
caggaaataaacttgccattaacttggggac

SEQ ID NO: 272 - DNA, 31 bp, Artificial Sequence
  Mutagenesis primer
gtccccaagttaatggcaagtttatttcctg

SEQ ID NO: 273 - DNA, 32 bp, Artificial Sequence
  Mutagenesis primer
gataaatttacaattgcagaaattaagcctgc

SEQ ID NO: 274 - DNA, 32 bp, Artificial Sequence
  Mutagenesis primer
gcaggcttaatttctgcaattgtaaatttatc

SEQ ID NO: 275 - DNA, 31 bp, Artificial Sequence
  Mutagenesis primer
gaagcttggggagatgcatttacaattttag

SEQ ID NO: 276 - DNA, 31 bp, Artificial Sequence
  Mutagenesis primer
ctaaaattgtaaatgcatctccccaagcttc

SEQ ID NO: 277 - DNA, 28 bp, Artificial Sequence
  Mutagenesis primer
gaagcttggggagctaaatttacaattt

SEQ ID NO: 278 - DNA, 28 bp, Artificial Sequence
  Mutagenesis primer
aaattgtaaatttagctccccaagcttc

SEQ ID NO: 279 - DNA, 37 bp, Artificial Sequence
  Mutagenesis primer
caaaatggagatgaagctgcgggagataaatttacaa

SEQ ID NO: 280 - DNA, 37 bp, Artificial Sequence
  Mutagenesis primer
ttgtaaatttatctcccgcagcttcatctccattttg

SEQ ID NO: 281 - DNA, 33 bp, Artificial Sequence
  Mutagenesis primer
gggagtgtatttaattgcaaaaagtcaaaatgg

SEQ ID NO: 282 - DNA, 33 bp, Artificial Sequence
  Mutagenesis primer
ccattttgactttttgcaattaaatacactccc

SEQ ID NO: 283 - DNA, 36 bp, Artificial Sequence
  Mutagenesis primer
ctacaggaactgatttagcgggagtgtatttaattt

SEQ ID NO: 284 - DNA, 36 bp, Artificial Sequence
  Mutagenesis primer
aaattaaatacactcccgctaaatcagttcctgtag

SEQ ID NO: 285 - DNA, 34 bp, Artificial Sequence
  Mutagenesis primer
ttactacaggaactgatgcaaagggagtgtattt

SEQ ID NO: 286 - DNA, 34 bp, Artificial Sequence
  Mutagenesis primer'
aaatacactccctttgcatcagttcctgtagtaa

SEQ ID NO: 287 - DNA, 35 bp, Artificial Sequence
  Mutagenesis primer
ctattactaaacgttttgctacaggaactgattta

SEQ ID NO: 288 - DNA, 35 bp, Artificial Sequence
  Mutagenesis primer
taaatcagttcctgtagcaaaacgtttagtaatag

SEQ ID NO: 289 - DNA, 36 bp, Artificial Sequence
  Mutagenesis primer
taataatttaaaagatgctcaaactattactaaacg

SEQ ID NO: 290 - DNA, 36 bp, Artificial Sequence
  Mutagenesis primer
cgtttagtaatagtttgagcatcttttaaattatta

SEQ ID NO: 291 - DNA, 32 bp, Artificial Sequence
  Mutagenesis primer
gaagatacaaataatgctttaaaagattatca

SEQ ID NO: 292 - DNA, 32 bp, Artificial Sequence
  Mutagenesis primer
tgataatcttttaaagcattatttgtatcttc

SEQ ID NO: 293 - DNA, 30 bp, Artificial Sequence
  Mutagenesis primer
atactggatatattgcttatgaagatacaa

SEQ ID NO: 294 - DNA, 30 bp, Artificial Sequence
  Mutagenesis primer
ttgtatcttcataagcaatatatccagtat

SEQ ID NO: 295 - DNA, 32 bp, Artificial Sequence
  Mutagenesis primer
gaaaatactggatatgctcattatgaagatac

SEQ ID NO: 296 - DNA, 32 bp, Artificial Sequence
  Mutagenesis primer
gtatcttcataatgagcatatccagtattttc

SEQ ID NO: 297 - DNA, 37 bp, Artificial Sequence
  Mutagenesis primer
catttaaaagatgaaaatgctggatatattcattatg

SEQ ID NO: 298 - DNA, 37 bp, Artificial Sequence
  Mutagenesis primer
cataatgaatatatccagcattttcatcttttaaatg

SEQ ID NO: 299 - DNA, 35 bp, Artificial Sequence
  Mutagenesis primer
ggaaaaccttctattgctttaaaagatgaaaatac

SEQ ID NO: 300 - DNA, 35 bp, Artificial Sequence
  Mutagenesis primer
gtattttcatcttttaaagcaatagaaggttttcc

SEQ ID NO: 301 - DNA, 33 bp, Artificial Sequence
  Mutagenesis primer
gtatgtaatccaatatgctgttaaaggaaaacc

SEQ ID NO: 302 - DNA, 33 bp, Artificial Sequence
  Mutagenesis primer
ggttttcctttaacagcatattggattacatac

SEQ ID NO: 303 - DNA, 31 bp, Artificial Sequence
  Mutagenesis primer
ggagataagttaaaagcgaaaactgagtatg

SEQ ID NO: 304 - DNA, 31 bp, Artificial Sequence
  Mutagenesis primer
catactcagttttcgcttttaacttatctcc

SEQ ID NO: 305 - DNA, 34 bp, Artificial Sequence
  Mutagenesis primer
cgggtccatagaagaggccaatttagagccgtgg

SEQ ID NO: 306 - DNA, 34 bp, Artificial Sequence
  Mutagenesis primer
ccacggctctaaattggcctcttctatggacccg

SEQ ID NO: 307 - DNA, 35 bp, Artificial Sequence
  Mutagenesis primer
tgtagagaacgggtccgcagaagaggacaatttag

SEQ ID NO: 308 - DNA, 35 bp, Artificial Sequence
  Mutagenesis primer
ctaaattgtcctcttctgcggacccgttctctaca

SEQ ID NO: 309 - DNA, 33 bp, Artificial Sequence
  Mutagenesis primer
tattgtagagaacggggccatagaagaggacaa

SEQ ID NO: 310 - DNA, 33 bp, Artificial Sequence
  Mutagenesis primer
ttgtcctcttctatggccccgttctctacaata

SEQ ID NO: 311 - DNA, 42 bp, Artificial Sequence
  Mutagenesis primer
ctaaattgatcgtcccaccagctggttttattagcaatattg

SEQ ID NO: 312 - DNA, 42 bp, Artificial Sequence
  Mutagenesis primer
caatattgctaataaaaccagctggtgggacgatcaatttag

SEQ ID NO: 313 - DNA, 30 bp, Artificial Sequence
  Mutagenesis primer
catatttaagagaagcactgctagcaacag

SEQ ID NO: 314 - DNA, 30 bp, Artificial Sequence
  Mutagenesis primer
ctgttgctagcagtgcttctcttaaatatg

SEQ ID NO: 315 - DNA, 37 bp, Artificial Sequence
  Mutagenesis primer
gaaaattcaagattaattgctttaacatgtaaatcat

SEQ ID NO: 316 - DNA, 37 bp, Artificial Sequence
  Mutagenesis primer
atgatttacatgttaaagcaattaatcttgaattttc

SEQ ID NO: 317 - DNA, 35 bp, Artificial Sequence
  Mutagenesis primer
gaaaattcaagattagctactttaacatgtaaatc

SEQ ID NO: 318 - DNA, 35 bp, Artificial Sequence
  Mutagenesis primer
gatttacatgttaaagtagctaatcttgaattttc

SEQ ID NO: 319 - DNA, 32 bp, Artificial Sequence
  Mutagenesis primer
gctgatgaaaattcagcattaattactttaac

SEQ ID NO: 320 - DNA, 32 bp, Artificial Sequence
  Mutagenesis primer
gttaaagtaattaatgctgaattttcatcagc

SEQ ID NO: 321 - DNA, 39 bp, Artificial Sequence
  Mutagenesis primer
gataaatgggtttggcctcgcagctgatgaaaattcaag

SEQ ID NO: 322 - DNA, 39 bp, Artificial Sequence
  Mutagenesis primer
cttgaattttcatcagctgcgaggccaaacccatttatc

SEQ ID NO: 323 - DNA, 36 bp, Artificial Sequence
  Mutagenesis primer
gataaatgggtttggcgcccaagctgatgaaaattc

SEQ ID NO: 324 - DNA, 36 bp, Artificial Sequence
  Mutagenesis primer
gaattttcatcagcttgggcgccaaacccatttatc

SEQ ID NO: 325 - DNA, 34 bp, Artificial Sequence
  Mutagenesis primer
gtatatgccattaggtgccatcagtgaaacattt

SEQ ID NO: 326 - DNA, 34 bp, Artificial Sequence
  Mutagenesis primer
aaatgtttcactgatggcacctaatggcatatac

SEQ ID NO: 327 - DNA, 32 bp, Artificial Sequence
  Mutagenesis primer
gatacggataaattagcttgtccagatcaatc

SEQ ID NO: 328 - DNA, 32 bp, Artificial Sequence
  Prime
gattgatctggacaagctaatttatccgtatc

SEQ ID NO: 329 - DNA, 33 bp, Artificial Sequence
  Mutagenesis primer
ggttatttatggtgatgcggataaattattttg

SEQ ID NO: 330 - DNA, 33 bp, Artificial Sequence
  Mutagenesis primer
caaaataatttatccgcatcaccataaataacc

SEQ ID NO: 331 - DNA, 30 bp, Artificial Sequence
  Mutagenesis primer
ccttatcggaggttgcttatggtgatacgg

SEQ ID NO: 332 - DNA, 30 bp, Artificial Sequence
  Mutagenesis primer
ccgtatcaccataagcaacctccgataagg

SEQ ID NO: 333 - DNA, 35 bp, Artificial Sequence
  Mutagenesis primer
ggattccttatcggaggctatttatggtgatacgg

SEQ ID NO: 334 - DNA, 35 bp, Artificial Sequence
  Mutagenesis primer
ccgtatcaccataaatagcctccgataaggaatcc

SEQ ID NO: 335 - DNA, 37 bp, Artificial Sequence
  Mutagenesis primer
gtggaagctaaaccaggagctgcattggttgggtttg

SEQ ID NO: 336 - DNA, 37 bp, Artificial Sequence
  Mutagenesis primer
caaacccaaccaatgcagctcctggtttagcttccac

SEQ ID NO: 337 - DNA, 37 bp, Artificial Sequence
  Mutagenesis primer
gtgatgaagatgcaaaggcgattgtggaagctaaacc

SEQ ID NO: 338 - DNA, 37 bp, Artificial Sequence
  Mutagenesis primer
ggtttagcttccacaatcgcctttgcatcttcatcac

SEQ ID NO: 339 - DNA, 34 bp, Artificial Sequence
  Mutagenesis primer
cctaattatgcaaaatctaaaggaagtgatgaag

SEQ ID NO: 340 - DNA, 34 bp, Artificial Sequence
  Mutagenesis primer
cttcatcacttcctttagattttgcataattagg

SEQ ID NO: 341 - DNA, 34 bp, Artificial Sequence
  Mutagenesis primer
cctaattatgcaaaaactaaaggaagtgatgaag

SEQ ID NO: 342 - DNA, 34 bp, Artificial Sequence
  Mutagenesis primer
cttcatcacttcctttagtttttgcataattagg

SEQ ID NO: 343 - DNA, 34 bp, Artificial Sequence
  Mutagenesis primer
cctaattatgcaaaaaataaaggaagtgatgaag

SEQ ID NO: 344 - DNA, 34 bp, Artificial Sequence
  Mutagenesis primer
cttcatcacttcctttattttttgcataattagg

SEQ ID NO: 345 - DNA, 34 bp, Artificial Sequence
  Mutagenesis primer
cctaattatgcaaaacaaaaaggaagtgatgaag

SEQ ID NO: 346 - DNA, 34 bp, Artificial Sequence
  Mutagenesis primer
cttcatcacttcctttttgttttgcataattagg

SEQ ID NO: 347 - DNA, 34 bp, Artificial Sequence
  Mutagenesis primer
cctaattatgcaaaaggtaaaggaagtgatgaag

SEQ ID NO: 348 - DNA, 34 bp, Artificial Sequence
  Mutagenesis primer
cttcatcacttcctttaccttttgcataattagg

SEQ ID NO: 349 - DNA, 31 bp, Artificial Sequence
  Mutagenesis primer
gaagcggagtatgtaacgttaagtgctaatg

SEQ ID NO: 350 - DNA, 31 bp, Artificial Sequence
  Mutagenesis primer
cattagcacttaacgttacatactccgcttc

SEQ ID NO: 351 - DNA, 31 bp, Artificial Sequence
  Mutagenesis primer
gaagcggagtatctaacgttaagtgctaatg

SEQ ID NO: 352 - DNA, 31 bp, Artificial Sequence
  Mutagenesis primer
cattagcacttaacgttagatactccgcttc

SEQ ID NO: 353 - DNA, 31 bp, Artificial Sequence
  Mutagenesis primer
gaagcggagtatacaacgttaagtgctaatg

SEQ ID NO: 354 - DNA, 31 bp, Artificial Sequence
  Mutagenesis primer
cattagcacttaacgttgtatactccgcttc

SEQ ID NO: 355 - DNA, 31 bp, Artificial Sequence
  Mutagenesis primer
gaagcggagtataatacgttaagtgctaatg

SEQ ID NO: 356 - DNA, 31 bp, Artificial Sequence
  Mutagenesis primer
cattagcacttaacgtattatactccgcttc

SEQ ID NO: 357 - DNA, 31 bp, Artificial Sequence
  Mutagenesis primer
gaagcggagtatcaaacgttaagtgctaatg

SEQ ID NO: 358 - DNA, 31 bp, Artificial Sequence
  Mutagenesis primer
cattagcacttaacgtttgatactccgcttc

SEQ ID NO: 359 - DNA, 32 bp, Artificial Sequence
  Mutagenesis primer
gttaagtgctaatgttgatggagtgtatatgc

SEQ ID NO: 360 - DNA, 32 bp, Artificial Sequence
  Mutagenesis primer
gcatatacactccatcaacattagcacttaac

SEQ ID NO: 361 - DNA, 32 bp, Artificial Sequence
  Mutagenesis primer
gttaagtgctaatattgatggagtgtatatgc

SEQ ID NO: 362 - DNA, 32 bp, Artificial Sequence
  Mutagenesis primer
gcatatacactccatcaatattagcacttaac

SEQ ID NO: 363 - DNA, 32 bp, Artificial Sequence
  Mutagenesis primer
gttaagtgctaataatgatggagtgtatatgc

SEQ ID NO: 364 - DNA, 32 bp, Artificial Sequence
  Mutagenesis primer
gcatatacactccatcattattagcacttaac

SEQ ID NO: 365 - DNA, 32 bp, Artificial Sequence
  Mutagenesis primer
gttaagtgctaatcaagatggagtgtatatgc

SEQ ID NO: 366 - DNA, 32 bp, Artificial Sequence
  Mutagenesis primer
gcatatacactccatcttgattagcacttaac

SEQ ID NO: 367 - DNA, 32 bp, Artificial Sequence
  Mutagenesis primer
gttaagtgctaatcgtgatggagtgtatatgc

SEQ ID NO: 368 - DNA, 32 bp, Artificial Sequence
  Mutagenesis primer
gcatatacactccatcacgattagcacttaac

SEQ ID NO: 369 - DNA, 37 bp, Artificial Sequence
  Mutagenesis primer
gaaattgacttaaataaggtaaaagtagaatcaagtg

SEQ ID NO: 370 - DNA, 37 bp, Artificial Sequence
  Mutagenesis primer
cacttgattctacttttaccttatttaagtcaatttc

SEQ ID NO: 371 - DNA, 37 bp, Artificial Sequence
  Mutagenesis primer
gaaattgacttaaataagataaaagtagaatcaagtg

SEQ ID NO: 372 - DNA, 37 bp, Artificial Sequence
  Mutagenesis primer
cacttgattctacttttatcttatttaagtcaatttc

SEQ ID NO: 373 - DNA, 37 bp, Artificial Sequence
  Mutagenesis primer
gaaattgacttaaataagggaaaagtagaatcaagtg

SEQ ID NO: 374 - DNA, 37 bp, Artificial Sequence
  Mutagenesis primer
cacttgattctacttttcccttatttaagtcaatttc

SEQ ID NO: 375 - DNA, 37 bp, Artificial Sequence
  Mutagenesis primer
gaaattgacttaaataagtcaaaagtagaatcaagtg

SEQ ID NO: 376 - DNA, 37 bp, Artificial Sequence
  Mutagenesis primer
cacttgattctacttttgacttatttaagtcaatttc

SEQ ID NO: 377 - DNA, 37 bp, Artificial Sequence
  Mutagenesis primer
gaaattgacttaaataagaacaaagtagaatcaagtg

SEQ ID NO: 378 - DNA, 37 bp, Artificial Sequence
  Mutagenesis primer
cacttgattctactttgttcttatttaagtcaatttc

SEQ ID NO: 379 - DNA, 37 bp, Artificial Sequence
  Mutagenesis primer
gaaattgacttaaataaggaaaaagtagaatcaagtg

SEQ ID NO: 380 - DNA, 37 bp, Artificial Sequence
  Mutagenesis primer
cacttgattctactttttccttatttaagtcaatttc

SEQ ID NO: 381 - DNA, 32 bp, Artificial Sequence
  Mutagenesis primer
gatacggataaattacagtgtccagatcaatc

SEQ ID NO: 382 - DNA, 32 bp, Artificial Sequence
  Mutagenesis primer
gattgatctggacactgtaatttatccgtatc

SEQ ID NO: 383 - DNA, 32 bp, Artificial Sequence
  Mutagenesis primer
gatacggataaattatcttgtccagatcaatc

SEQ ID NO: 384 - DNA, 32 bp, Artificial Sequence
  Mutagenesis primer
gattgatctggacaagataatttatccgtatc

SEQ ID NO: 385 - DNA, 32 bp, Artificial Sequence
  Mutagenesis primer
gatacggataaattaatgtgtccagatcaatc

SEQ ID NO: 386 - DNA, 32 bp, Artificial Sequence
  Mutagenesis primer
gattgatctggacacattaatttatccgtatc

SEQ ID NO: 387 - DNA, 32 bp, Artificial Sequence
  Mutagenesis primer
gatacggataaattatggtgtccagatcaatc

SEQ ID NO: 388 - DNA, 32 bp, Artificial Sequence
  Mutagenesis primer
gattgatctggacaccataatttatccgtatc

SEQ ID NO: 389 - DNA, 32 bp, Artificial Sequence
  Mutagenesis primer
gatacggataaattatattgtccagatcaatc

SEQ ID NO: 390 - DNA, 32 bp, Artificial Sequence
  Mutagenesis primer
gattgatctggacaatataatttatccgtatc

SEQ ID NO: 391 - DNA, 32 bp, Artificial Sequence
  Mutagenesis primer
gatacggataaattagagtgtccagatcaatc

SEQ ID NO: 392 - DNA, 32 bp, Artificial Sequence
  Mutagenesis primer
gattgatctggacactctaatttatccgtatc

SEQ ID NO: 393 - DNA, 32 bp, Artificial Sequence
  Mutagenesis primer
gatacggataaattacgttgtccagatcaatc

SEQ ID NO: 394 - DNA, 32 bp, Artificial Sequence
  Mutagenesis primer
gattgatctggacaacgtaatttatccgtatc

SEQ ID NO: 395 - DNA, 34 bp, Artificial Sequence
  Mutagenesis primer
gaaataaacttttcattgagttggggacaaatgg

SEQ ID NO: 396 - DNA, 34 bp, Artificial Sequence
  Mutagenesis primer
ccatttgtccccaactcaatgaaaagtttatttc

SEQ ID NO: 397 - DNA, 34 bp, Artificial Sequence
  Mutagenesis primer
gaaataaacttttcattcgcttggggacaaatgg

SEQ ID NO: 398 - DNA, 34 bp, Artificial Sequence
  Mutagenesis primer
ccatttgtccccaagcgaatgaaaagtttatttc

SEQ ID NO: 399 - DNA, 34 bp, Artificial Sequence
  Mutagenesis primer
gaaataaacttttcattagtttggggacaaatgg

SEQ ID NO: 400 - DNA, 34 bp, Artificial Sequence
  Mutagenesis primer
ccatttgtccccaaactaatgaaaagtttatttc

SEQ ID NO: 401 - DNA, 34 bp, Artificial Sequence
  Mutagenesis primer
gaaataaacttttcattctcttggggacaaatgg

SEQ ID NO: 402 - DNA, 34 bp, Artificial Sequence
  Mutagenesis primer
ccatttgtccccaagagaatgaaaagtttatttc

SEQ ID NO: 403 - DNA, 34 bp, Artificial Sequence
  Mutagenesis primer
gaaataaacttttcattatgttggggacaaatgg

SEQ ID NO: 404 - DNA, 34 bp, Artificial Sequence
  Mutagenesis primer
ccatttgtccccaacataatgaaaagtttatttc

SEQ ID NO: 405 - DNA, 34 bp, Artificial Sequence
  Mutagenesis primer
gaaataaacttttcatttggttggggacaaatgg

SEQ ID NO: 406 - DNA, 34 bp, Artificial Sequence
  Mutagenesis primer
ccatttgtccccaaccaaatgaaaagtttatttc

SEQ ID NO: 407 - DNA, 34 bp, Artificial Sequence
  Mutagenesis primer
gaaataaacttttcatttacttggggacaaatgg

SEQ ID NO: 408 - DNA, 34 bp, Artificial Sequence
  Mutagenesis primer
ccatttgtccccaagtaaatgaaaagtttatttc

SEQ ID NO: 409 - DNA, 34 bp, Artificial Sequence
  Mutagenesis primer
gaaataaacttttcattttcttggggacaaatgg

SEQ ID NO: 410 - DNA, 34 bp, Artificial Sequence
  Mutagenesis primer
ccatttgtccccaagaaaatgaaaagtttatttc

SEQ ID NO: 411 - DNA, 33 bp, Artificial Sequence
  Mutagenesis primer
aataccggattatatatggaactttcccgtcgc

SEQ ID NO: 412 - DNA, 33 bp, Artificial Sequence
  Mutagenesis primer
gcgacgggaaagttccatatataatccggtatt

SEQ ID NO: 413 - DNA, 33 bp, Artificial Sequence
  Mutagenesis primer
aataccggattatattgggaactttcccgtcgc

SEQ ID NO: 414 - DNA, 33 bp, Artificial Sequence
  Mutagenesis primer
gcgacgggaaagttcccaatataatccggtatt

SEQ ID NO: 415 - DNA, 33 bp, Artificial Sequence
  Mutagenesis primer
aataccggattatattatgaactttcccgtcgc

SEQ ID NO: 416 - DNA, 33 bp, Artificial Sequence
  Mutagenesis primer
gcgacgggaaagttcataatataatccggtatt

SEQ ID NO: 417 - DNA, 33 bp, Artificial Sequence
  Mutagenesis primer
aataccggattatatgaagaactttcccgtcgc

SEQ ID NO: 418 - DNA, 33 bp, Artificial Sequence
  Mutagenesis primer
gcgacgggaaagttcttcatataatccggtatt

SEQ ID NO: 419 - DNA, 33 bp, Artificial Sequence
  Mutagenesis primer
aataccggattatatcgagaactttcccgtcgc

SEQ ID NO: 420 - DNA, 33 bp, Artificial Sequence
  Mutagenesis primer
gcgacgggaaagttctcgatataatccggtatt

SEQ ID NO: 421 - DNA, 33 bp, Artificial Sequence
  Mutagenesis primer
aataccggattatatcaagaactttcccgtcgc

SEQ ID NO: 422 - DNA, 33 bp, Artificial Sequence
  Mutagenesis primer
gcgacgggaaagttcttgatataatccggtatt

SEQ ID NO: 423 - DNA, 33 bp, Artificial Sequence
  Mutagenesis primer
aataccggattatatacagaactttcccgtcgc

SEQ ID NO: 424 - DNA, 33 bp, Artificial Sequence
  Mutagenesis primer
gcgacgggaaagttctgtatataatccggtatt

SEQ ID NO: 425 - DNA, 36 bp, Artificial Sequence
  Mutagenesis primer
gataaatgggtttggcatgcaagctgatgaaaattc

SEQ ID NO: 426 - DNA, 36 bp, Artificial Sequence
  Mutagenesis primer
gaattttcatcagcttgcatgccaaacccatttatc

SEQ ID NO: 427 - DNA, 36 bp, Artificial Sequence
  Mutagenesis primer
gataaatgggtttggctggcaagctgatgaaaattc

SEQ ID NO: 428 - DNA, 36 bp, Artificial Sequence
  Mutagenesis primer
gaattttcatcagcttgccagccaaacccatttatc

SEQ ID NO: 429 - DNA, 36 bp, Artificial Sequence
  Mutagenesis primer
gataaatgggtttggctaccaagctgatgaaaattc

SEQ ID NO: 430 - DNA, 36 bp, Artificial Sequence
  Mutagenesis primer'
gaattttcatcagcttggtagccaaacccatttatc

SEQ ID NO: 431 - DNA, 36 bp, Artificial Sequence
  Mutagenesis primer
gataaatgggtttggcgagcaagctgatgaaaattc

SEQ ID NO: 432 - DNA, 36 bp, Artificial Sequence
  Mutagenesis primer
gaattttcatcagcttgctcgccaaacccatttatc

SEQ ID NO: 433 - DNA, 36 bp, Artificial Sequence
  Mutagenesis primer
gataaatgggtttggccgccaagctgatgaaaattc

SEQ ID NO: 434 - DNA, 36 bp, Artificial Sequence
  Mutagenesis primer
gaattttcatcagcttggcggccaaacccatttatc

SEQ ID NO: 435 - DNA, 36 bp, Artificial Sequence
  Mutagenesis primer
gataaatgggtttggccagcaagctgatgaaaattc

SEQ ID NO: 436 - DNA, 36 bp, Artificial Sequence
  Mutagenesis primer
gaattttcatcagcttgctggccaaacccatttatc

SEQ ID NO: 437 - DNA, 36 bp, Artificial Sequence
  Mutagenesis primer
gataaatgggtttggcacccaagctgatgaaaattc

SEQ ID NO: 438 - DNA, 36 bp, Artificial Sequence
  Mutagenesis primer
gaattttcatcagcttgggtgccaaacccatttatc

SEQ ID NO: 439 - DNA, 34 bp, Artificial Sequence
  Mutagenesis primer
ttactacaggaactgatgaaaagggagtgtattt

SEQ ID NO: 440 - DNA, 34 bp, Artificial Sequence
  Mutagenesis primer
aaatacactcccttttcatcagttcctgtagtaa

SEQ ID NO: 441 - DNA, 34 bp, Artificial Sequence
  Mutagenesis primer
ttactacaggaactgatatgaagggagtgtattt

SEQ ID NO: 442 - DNA, 34 bp, Artificial Sequence
  Mutagenesis primer
aaatacactcccttcatatcagttcctgtagtaa

SEQ ID NO: 443 - DNA, 34 bp, Artificial Sequence
  Mutagenesis primer
ttactacaggaactgataataagggagtgtattt

SEQ ID NO: 444 - DNA, 34 bp, Artificial Sequence
  Mutagenesis primer
aaatacactcccttattatcagttcctgtagtaa

SEQ ID NO: 445 - DNA, 34 bp, Artificial Sequence
  Mutagenesis primer
ttactacaggaactgatcgaaagggagtgtattt

SEQ ID NO: 446 - DNA, 34 bp, Artificial Sequence
  Mutagenesis primer
aaatacactccctttcgatcagttcctgtagtaa

SEQ ID NO: 447 - DNA, 34 bp, Artificial Sequence
  Mutagenesis primer
ttactacaggaactgattcaaagggagtgtattt

SEQ ID NO: 448 - DNA, 34 bp, Artificial Sequence
  Mutagenesis primer
aaatacactccctttgaatcagttcctgtagtaa

SEQ ID NO: 449 - DNA, 34 bp, Artificial Sequence
  Mutagenesis primer
ttactacaggaactgattggaagggagtgtattt

SEQ ID NO: 450 - DNA, 34 bp, Artificial Sequence
  Mutagenesis primer
aaatacactcccttccaatcagttcctgtagtaa

SEQ ID NO: 451 - DNA, 34 bp, Artificial Sequence
  Mutagenesis primer
ttactacaggaactgattataagggagtgtattt

SEQ ID NO: 452 - DNA, 34 bp, Artificial Sequence
  Mutagenesis primer
aaatacactcccttataatcagttcctgtagtaa

SEQ ID NO: 453 - protein, 26 aa, Artificial Sequence
  Short Vector Epitope Sequence
GMASMATGGQQMGRDLYDDDDKDPTL

SEQ ID NO: 454 - DNA, 2367 bp, Artificial Sequence
  Maize-optimized Vip3E coding sequence (K455A mutant)
atgaacatgaacaacaccaagctcaacgcccgcgccctcccgtccttcatcgactacttcaacggcatctacggcttcgccaccggcatcaaggacatcatgaacatgatcttcaagaccgacaccggcggcaacctcaccctcgacgagatcctcaagaaccagcagctcctcaacgagatcagcggcaagctcgacggcgtgaacggctccctcaacgacctcatcgcccagggcaacctcaacaccgagctgtccaaggagatcctcaagatcgccaacgagcagaaccaggtgctcaacgacgtgaacaacaagctcgacgccatcaacaccatgctccacatctacctcccgaagatcacctccatgctctccgacgtgatgaagcagaactacgccctctccctccagatcgagtacctctccaagcagctccaggagatcagcgacaagctcgacatcatcaacgtgaacgtgctcatcaactccaccctcaccgagatcaccccggcctaccagcgcatcaagtacgtgaacgagaagttcgaggagctgaccttcgccaccgagaccaccctcaaggtgaagaaggactcctccccggccgacatcctcgacgagctgaccgagctgaccgagctggccaagtccgtgaccaagaacgacgtggacggcttcgagttctacctcaacaccttccacgacgtgatggtgggcaacaacctcttcggccgctccgccctcaagaccgcctccgagctgatcgccaaggagaacgtgaagacctccggctccgaggtgggcaacgtgtacaacttcctcatcgtgctcaccgccctgcaggccaaggccttcctcaccctcaccacctgccgcaagctcctcggcctcgccgacatcgactacacctccatcatgaacgagcacctcaacaaggagaaggaggagttccgcgtgaacatcctcccgaccctctccaacaccttctccaacccgaactacgccaaggtgaagggctccgacgaggacgccaagatgatcgtggaggccaagccgggccacgccctcgtgggcttcgagatgtccaacgactccatcaccgtgctcaaggtgtacgaggccaagctcaagcagaactaccaggtggacaaggactccctctccgaggtgatctacggcgacaccgacaagctcttctgcccggaccagtccgagcagatatactacaccaacaacatcgtgttcccgaacgagtacgtgatcaccaagatcgacttcaccaagaagatgaagaccctccgctacgaggtgaccgccaacttctacgactcctccaccggcgagatcgacctcaacaaggcgaaggtggagtcctccgaggccgagtaccgcaccctctccgccaacgacgacggcgtgtacatgccgctcggcgtgatctccgaaaccttcctcaccccgatcaacggcttcggcctccaggccgacgagaactcccgcctcatcaccctcacctgcaagtcctacctccgcgagctgctcctcgccaccgacctctccaacaaggagaccaagctcatcgtgccgccgtccggcttcatctccaacatcgtggagaacggctccatcgaggaggacaacctcgagccgtggaaggccaacaacaagaacgcctacgtggaccacaccggcggcgtgaacggcaccaaggccctctacgtgcacaaggacggcggcttctcccagttcatcggcgacaagctcaagccgaagaccgagtacgtgatccagtacaccgtgaagggcaagccgtccatccacctcaaggacgagaacaccggctacatccactacgaggacaccaacaacaacctcaaggactaccagaccatcaccaagcgcttcaccaccggcaccgacctcaagggcgtgtacctcatcctcaagtcccagaacggcgacgaggcctggggcgacaagttcaccatccttgagatcaagccggccgaggacctcctctccccggagctgatcaacccgaactcctggatcaccaccccgggcgcctccatctccggcaacaagctcttcatcaacctcggcaccaacggcaccttccgccagtccctctccctcaactcctactccacctactccatctccttcaccgcctccggcccgttcaacgtgaccgtgcgcaactcccgcgaggtgctcttcgagcgctccaacctcatgtcctccacctcccacatctccggcaccttcaagaccgagtccaacaacaccggcctctacgtggagctgtcccgccgctccggcggcggcggccacatctccttcgagaacgtgtccatcaagtag

SEQ ID NO: 455 - protein, 633 aa, Bacillus thuringiensis
MNNVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 456 - protein, 622 aa, Bacillus thuringiensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANFNLSFIRGVILNADEWGISAATVRTYRDHLRKFHRDYSNYCINPYQTAFRGLNHRLPDMLEFRTYMFLNVFEYVSIWSLFKYQSLLVSSGANLYASGSGPTQSFTAQNWPFLYSLFQVNSNYVLNGLSGARTTITFPNIGGLPVYHNSTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNPTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 457 - protein, 633 aa, Bacillus thuringiensis
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

What is claimed:

1. An engineered Vip3 pesticidal polypeptide comprising an amino acid sequence having at least 95% identity to SEQ ID NO:1 and further comprising at least one amino acid mutation at a position that corresponds to a position selected from the group consisting of V338, K455, D471, Q495, R501, S532, S543, I544, G580, P591, P605, H608, Y616, I617, H618, R635, K643, W658, P681, S712, I753, E760, V768, S774, G775, and H779, wherein the at least one amino acid mutation at a position corresponding to V338 is A, N, T, P or G; or to K455 is A, G, I or E; or to D471 is A, N, or T; or to Q495 is A, or to R501 is A, or to S532 is N, K, M or D; or to S543 is A, or to I544 is A or N; or to G580 is A, W or E; or to P591 is A, or to P605 is A, or to H608 is A or L; or to Y616 is A, or to I617 is A, or to H618 is A, or to R635 is A; or to K643 is A or S; or to W658 is A, or to P681 is A, or to S712 is A, or to I753 is A, or to E760 is A, or to V768 is A, or to S774 is A, or to G775 is A, or to H779 is A, and wherein the mutation improves pesticidal activity of the engineered polypeptide against at least *Ostrinia nubilalis* (European corn borer, ECB) compared to the ECB activity of a wild-type Vip3 polypeptide that does not comprise the at least one mutation.

2. The engineered Vip3 pesticidal polypeptide of claim 1, wherein the at least one amino acid mutation corresponds to position K455, wherein the at least one amino acid mutation at a position that corresponds to K455 is A, G, I or E.

3. The engineered Vip3 pesticidal polypeptide according to claim 1, wherein the at least one amino acid mutation is at a position in SEQ ID NO:1 selected from the group consisting of V338, K455, D471, Q495, R501, S532, S543, I544, G580, P591, P605, H608, Y616, I617, H618, R635, K643, W658, P681, S712, I753, E760, V768, S774, G775, and H779, wherein the at least one amino acid mutation at position V338 is A, N, T, P or G; or at position K455 is A, G, I or E; or at position D471 is A, N, or T; or at position Q495 is A, or at position R501 is A, or at position S532 is N, K, M or D; or at position S543 is A, or at position I544 is A or N; or at position G580 is A, W or E; or at position P591 is A, or at position P605 is A, or at position H608 is A or L; or at position Y616 is A, or at position I617 is A, or at position H618 is A, or at position R635 is A; or at position K643 is A or S; or at position W658 is A, or at position P681 is A, or at position S712 is A, or at position I753 is A, or at position E760 is A, or at position V768 is A, or at position S774 is A, or at position G775 is A, or at position H779 is A, and wherein the mutation improves pesticidal activity of the engineered polypeptide against at least *Ostrinia nubilalis* (European corn borer, ECB) compared to the ECB activity of the wild-type Vip3 polypeptide of SEQ ID NO:1.

4. The engineered Vip3 pesticidal polypeptide of claim 3, wherein the at least one amino acid mutation is at position K455, wherein the at least one amino acid mutation at a position that corresponds to K455 is A, G, I or E.

5. The engineered Vip3 pesticidal polypeptide of claim 1, wherein the at least one amino acid mutation at a position corresponding to
  a) I544 is A and S712 is A; or
  b) K455 is A and V338 is A; or
  c) H618 is A and T750 is A; or
  d) any combination of a) c).

6. The engineered Vip3 pesticidal polypeptide of claim 3, wherein the at least one amino acid mutation is selected from the group consisting of a mutation of I544A and of S712A, a mutation of K455A and of V338A, a mutation of H618A and of T750A, and any combination thereof.

7. The engineered Vip3 pesticidal polypeptide of claim 3, wherein the polypeptide comprises an amino acid sequence selected from the group consisting of the amino acid sequence of SEQ ID NO:3, the amino acid sequence of SEQ ID NO:5, the amino acid sequence of SEQ ID NO:7, the amino acid sequence of SEQ ID NO:9, the amino acid sequence of SEQ ID NO:11, the amino acid sequence of SEQ ID NO:13, the amino acid sequence of SEQ ID NO:20, the amino acid sequence of SEQ ID NO:22, the amino acid sequence of SEQ ID NO:26, the amino acid sequence of SEQ ID NO:28, the amino acid sequence of SEQ ID NO:30, the amino acid sequence of SEQ ID NO:32, the amino acid sequence of SEQ ID NO:34, the amino acid sequence of SEQ ID NO:36, the amino acid sequence of SEQ ID NO:38, the amino acid sequence of SEQ ID NO:40, the amino acid sequence of SEQ ID NO:42, the amino acid sequence of SEQ ID NO:44, the amino acid sequence of SEQ ID NO:46, the amino acid sequence of SEQ ID NO:48, the amino acid sequence of SEQ ID NO:50, the amino acid sequence of SEQ ID NO:52, the amino acid sequence of SEQ ID NO:54, the amino acid sequence of SEQ ID NO:56, the amino acid sequence of SEQ ID NO:58, the amino acid sequence of SEQ ID NO:60, the amino acid sequence of SEQ ID NO:115, the amino acid sequence of SEQ ID NO:117, the amino acid sequence of SEQ ID NO:119, and any combination thereof.

8. A recombinant nucleic acid molecule comprising a nucleotide sequence encoding the engineered Vip3 polypeptide of claim 1.

9. The recombinant nucleic acid molecule of claim 8, wherein the nucleotide sequence is selected from the group consisting of the nucleotide sequence of SEQ ID NO:4, the nucleotide sequence of SEQ ID NO:6, the nucleotide sequence of SEQ ID NO:8, the nucleotide sequence of SEQ ID NO:10, the nucleotide sequence of SEQ ID NO:12, the nucleotide sequence of SEQ ID NO:14, the nucleotide sequence of SEQ ID NO:21, the nucleotide sequence of SEQ ID NO:23, the nucleotide sequence of SEQ ID NO:27, the nucleotide sequence of SEQ ID NO:29, the nucleotide sequence of SEQ ID NO:31, the nucleotide sequence of SEQ ID NO:33, the nucleotide sequence of SEQ ID NO:35, the nucleotide sequence of SEQ ID NO:37, the nucleotide sequence of SEQ ID NO:39, the nucleotide sequence of SEQ ID NO:41, the nucleotide sequence of SEQ ID NO:43, the nucleotide sequence of SEQ ID NO:45, the nucleotide sequence of SEQ ID NO:47, the nucleotide sequence of SEQ ID NO:49, the nucleotide sequence of SEQ ID NO:51, the nucleotide sequence of SEQ ID NO:53, the nucleotide sequence of SEQ ID NO:55, the nucleotide sequence of SEQ ID NO:57, the nucleotide sequence of SEQ ID NO:59, the nucleotide sequence of SEQ ID NO:61, the nucleotide sequence of SEQ ID NO:116, the nucleotide sequence of SEQ ID NO:118, the nucleotide sequence of SEQ ID NO:120, and any combination thereof.

10. An expression cassette comprising the recombinant nucleic acid molecule of claim 8, wherein the nucleotide sequence is operatively associated with a heterologous promoter.

11. A recombinant vector comprising the expression cassette of claim 10.

12. A transgenic non-human host cell comprising the nucleic acid molecule of claim 10.

13. The transgenic non-human host cell according to claim 12, which is a bacterial cell or a plant cell, wherein the transgenic host cell comprises the nucleic acid molecule or the engineered Vip3 pesticidal polypeptide.

14. A transgenic plant comprising the plant cell of claim 13.

15. The transgenic plant of claim 14, wherein the plant is selected from the group consisting of sorghum, wheat, sunflower, tomato, cole crops, cotton, rice, soybean, sugar beet, sugar cane, tobacco, barley, oilseed rape and maize.

16. A product harvested from the transgenic plant of claim 14, wherein the product comprises the nucleic acid molecule or the engineered Vip3 pesticidal polypeptide.

17. A processed product produced from the harvested product of claim 16, wherein the processed product comprises the nucleic acid molecule or the engineered Vip3 pesticidal polypeptide.

18. A plurality of the plants of claim 14 planted together in an agricultural field.

19. The transgenic plant of claim 14, wherein the plant is further treated with a pesticidal agent.

20. The transgenic plant of claim 19, wherein the pesticidal agent is selected from the group consisting of tefluthrin, lambda cyhalothrin, bifenthrin, permethrin and cyfluthrin, pyrethrin, taufluvalinate, flumethrin, trans-cyfluthrin, kadethrin, bioresmethrin, tetramethrin, phenothrin, empenthrin, cyphenothrin, prallethrin, imiprothrin, allethrin, bioallethrin, a oxadiazine derivative, imidacloprid, acetamiprid, nitenpyram, chlorfenapyr, tebufenpyrad, fenpyroximate, tebufenozide, methoxyfenozide, halofenozide, triazamate, avermectin, spinosad, fipronil, acephate, fenamiphos, diazinon, chlorpyrifos, chlorpyrifon-methyl, malathion, carbaryl, aldicarb, carbofuran, thiodicarb and oxamyl.

21. A transgenic seed comprising the recombinant nucleic acid molecule of claim 10.

22. The transgenic seed of claim 18, wherein the seed has been further treated with a pesticidal agent.

23. The transgenic seed of claim 22, wherein the pesticidal agent is selected from the group consisting of tefluthrin, lambda cyhalothrin, bifenthrin, permethrin, cyfluthrin, pyrethrin, taufluvalinate, flumethrin, trans-cyfluthrin, kadethrin, bioresmethrin, tetramethrin, phenothrin, empenthrin, cyphenothrin, prallethrin, imiprothrin, allethrin, bioallethrin, a oxadiazine derivative, imidacloprid, acetamiprid, nitenpyram, chlorfenapyr, tebufenpyrad, fenpyroximate, tebufenozide, methoxyfenozide, halofenozide, triazamate, avermectin, spinosad, fipronil, acephate, fenamiphos, diazinon, chlorpyrifos, chlorpyrifon-methyl, malathion, carbaryl, aldicarb, carbofuran, thiodicarb and oxamyl.

24. A composition comprising the engineered Vip3 pesticidal polypeptide of claim 1 in an agriculturally acceptable carrier.

25. An extract from the transgenic plant of claim 14, wherein the extract comprises the recombinant nucleic acid molecule and/or the engineered Vip3 pesticidal polypeptide.

\* \* \* \* \*